United States Patent 7,432,049 (COMPOSITIONS AND METHODS RELATING TO OSTEOARTHRITIS) - sequence listing, part 9

SEQ ID NO: 56659 - DNA, 331 bp, Homo sapiens
  misc_feature 7, 31: n = A,T,C or G
aattcgngggcggatcctctctggcgtggtntccaagcacgaagatgcagaggaccattgtcatccgccgagactatctgcactacatccgcaagtacaaccgcttcgagaagcgccacaagaacatgtctgtacacctgtccccctgcttcagggacgtccagatcggtgacatcgtcacagtgggcgagtgccggcctctgagcaagacagtgcgcttcaacgtgctcaaggtcaccaaggctgccggcaccaagaagcagttccagaagttctgaggctggacatcggcccgctccccacaatgaaataaagttattttctcattcct

SEQ ID NO: 56660 - DNA, 463 bp, Homo sapiens
  misc_feature 6, 32: n = A,T,C or G
ggacanctcggtggtggccactgcgcagtatnagacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatacgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggcagggaaggaaagaacttgcatgttggtgaaggaagaagtggggtggaaga

SEQ ID NO: 56661 - DNA, 293 bp, Homo sapiens
  misc_feature 30, 47, 49: n = A,T,C or G
ctatggaccgggaagaaagcgtttctaagnagaacagcaagtaatantntagaaacagttacgtgtggaattcaacatctttggttggaacgcattggctttttttttcttgttttgatagaaatggaattaagcaaaagtagtttttgtcttttctgttgtcttcaaattttatgccttttatttttaatttaatcccgttcaattatttaattgttatacattgacattaactgctgtattctgactttgttcaataattttgttctttcagggctagaaataaacttttt

SEQ ID NO: 56662 - DNA, 392 bp, Homo sapiens
  misc_feature 251, 273, 308, 358: n = A,T,C or G
caggcgcaaacgggcataaattccagggaccactgggtgagagaggaataaggcccagagcgaggaaaggattttaccaaagcatcaatacaaccagcccaaccatcggtccacacctgggcatttggtgagagtcaaagctgaccatggatccctggggccaacggcaacagcatgggcctcacctcctctgtgatttctttctttgcaccaaagacatcagtctccaacatgtttctgttttgttgttngattcagcaaaaatctcccagngacaacatcgcaatagttttttacttctcttaggnggctctgggaatgggagaggggtaggatgtacaggggtagtttgttttanaaccagccgtattttacatgaagctgtataatta

SEQ ID NO: 56663 - DNA, 312 bp, Homo sapiens
  misc_feature 178: n = A,T,C or G
gccggtaatagtatattgcctgtatcttctacctctagtaatgggctttatgtgctagattttaatatccttgagcctgggcaagtgcacaagtctttttaaaagaaacatggtttacttgcacaaaactgatcagttttgagagatcgttaatgcccttgaagtggtttttgtgggngtgaaacaaatggtgagaatttgaattggtccctcctattatagtattgaaattaagtctacttaatttatcaagtcatgttcatgccctgattttatatacttgtatctatcaataaacattgtgatacttga

SEQ ID NO: 56664 - DNA, 500 bp, Homo sapiens
  misc_feature 66, 70, 75, 135, 139, 475: n = A,T,C or G
cactgtcgttctctctaaaaaatgacgattctggtcccattttaagagaacctctaggtaatttgngttngtctntgattttgcttatctttttctattagcattcattaagtgacactgaactagaattctganctgntctatccaggactataatttatggagttacaacaaaataagtgaagaagatatcaattctataggatggaccacattagaaacgtcttctatcttattgaattttaagtagctggcccctaataggctcttaacaaatgtacacctgattaatgtttgcattataataactaaatcttaatattaattgaaccctagttatcatagtttgtaatatcattttcactgtttcaatctttgcaaacttatgcttactaatacaacacaatctaagagaatgtgtctgtataaggatttttttaactgcagtaatatgctttctagctattgttaaggngaacttttgaacatttgtataacta

SEQ ID NO: 56665 - DNA, 294 bp, Homo sapiens
  misc_feature 33, 34, 61, 62, 158, 214: n = A,T,C or G
cggggaaacccaaagctttatcgtgttgtatannaaaattaacaatataatggcaataggnngagatacaacaaatgaatataacactataacacttcatattttccaaatcttaatttggatttaaggaagaaatcaataaatataaaatataagcncatatttattatatatctaaggtatacaaatctgtctacatgaagtttacaggatnggtaaatatcacctgctcaacatgtaattatttaataaaactttggaacattaaaaaaataaattggaggcttaaggatc

SEQ ID NO: 56666 - DNA, 447 bp, Homo sapiens
  misc_feature 18, 44: n = A,T,C or G
atgggccggggatacccnacctgatgcatattttccttcttttngagggcatttgtttggttaagaaggcttctttggactttggaatttcaacccagattttaccttgcagacggaatgacaagcaaaaagtgttgtggggaatcaaatttgttcctttcctcatgcacaaaacataaaggatagtggcgagtttacaagctgtggatgggtttccatagtcttcctttctgtacattgctatatcttcagtcctttggagcaagtggacctaacaagttgagcaaaatgaatatttggatccatgttcctcttgtgaccctgagtcttcatgcaaggagatccgaagctgaacaatgaaaatcttcagcagaaatagaaatggccgtggattgtaatacacactgaaattctgactttctgaatttaaatgtagaataaatttta

SEQ ID NO: 56667 - DNA, 380 bp, Homo sapiens
  misc_feature 2, 56, 208: n = A,T,C or G
anagcccagccatttgaataaattgtacattgtaaagcttatagtagctgattgtnttattgattgtattgtatactatattaaatgtgaatttgtaccccttcattttaaaaggtcattgtgttctactgcctattttagattactttggggttggggaagggtgttttggtaagcaggattttaagtcctctctctctcgattggntttatgaagatataaggttatgctcttactaccaagctcaggattcttgattttaaaggtacaaggatagttgtgggagttttatttttggttatatttgaactgtatgaatggtaggtctgaatattgagaatttccatggtcttatgtggaggtaaaatatacagataac

SEQ ID NO: 56668 - DNA, 237 bp, Homo sapiens
  misc_feature 33: n = A,T,C or G
agaatccgcaattgttgacttgcattcagaacntaaatgcacaaaatctgtacatgtctcccatcagaaagattcattggcatgccacaggggattctcctccttcatcctgtaaaggtcaacaataaaaaccaaattatggggctgcttttgtcacactagtatagagaatgtgttgaaatttaactttgtaagcttgtatgtggttgttgatcttttttttccttacagacacct

SEQ ID NO: 56669 - DNA, 456 bp, Homo sapiens
  misc_feature 2, 23: n = A,T,C or G
tnatggcggggataggcggcttnattgactgatttcccctattctcaggctacaccctagaaccaaacctacgccaaaatccatttcactatcatattcatcggcgtaaatctaactttcttcccacaacactttctcggcctatccggaatgccccgacgttactcggactaccccgatgcatacaccacatgaaacatcctatcatctgtaggctcattcatttctctaacagcagtaatattaataattttcatgatttgagaagccttcgcttcgaagcgaaaagtcctaatagtagaagaaccctccataaacctggagtgactatatggatgccccccaccctaccacacattcgaagaacccgtatacataaaatctagacaaaaaaggaaggaatcgaaccccccaaagctggtttcaagccaaccccatggcctccatgactttttg

SEQ ID NO: 56670 - DNA, 467 bp, Homo sapiens
  misc_feature 30: n = A,T,C or G
gtggccgtacaaataactataaaagcctgnttcctaaattagaaaatctgagttctttaccaccagattctgacagaacatcagaagtatatctacatgaagaattacagcaagacatgcaaaagtttaagaatgaggtcaacacattagaagaagagttcctggctttgaagaaagaaaatgttcaacttcataaagaggttgaagaagaaatggagaagcacagaagtaatagcacagaattatcaggaaccctaactgatggtactactgttggcaatgatgatgatggactaaatcagcagattcctaggaaggaaaatggagagcatgacaggcctgcagataaaacatctaatgaaaagaacgaggtcaaaaaccaaatatatcctgaggctgactttgctgactcaatggagccatctgaaatagcctcggaggattgtgaattgtctcactctgtttat

SEQ ID NO: 56671 - DNA, 299 bp, Homo sapiens
  misc_feature 9, 21, 28, 192, 195: n = A,T,C or G
acttcgctngtactcgggcgnctcggtnggtttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcnccnccaatatgcactgtacattccacaagcattgccttcttattttacttcttttagctgtttaactttgtaagatgcaaagaggttggatcaagtttaaatgactg

SEQ ID NO: 56672 - DNA, 411 bp, Homo sapiens
  misc_feature 2, 9, 61, 73, 91, 107, 140, 166, 179: n = A,T,C or G
gngctttgntggagatggctttacaagaaaaccacctaaatatgaaagattcatcaggccnatgggcttgcgnttcaagaaagcccatgtnacacatcctgaactgnaagccacccttttgcctaccaatacttggggtnaagaagaatccctcatccccactgtntacaacttcgggngttattaccaaagggactgtcattgaagtaaatgtgagcgaattgggccttgtgacacaaggaggcaaagttatttggggaaaatatgcccaggttaccaacaatcctgaaaatgatggatgtgtaaatgcagccttactgggttgacagcaatttcatatataattattgaggactacacaccaattgaagaaactgcccttactgtgatgtttctgaatactaccaaaca

SEQ ID NO: 56673 - DNA, 490 bp, Homo sapiens
  misc_feature 12: n = A,T,C or G
cacaaccaaagnaaaaacaacttaagtaagattttagaaataaatcttacaagaaatctaaaaaaggaggtacagtccaatgggatagtaatcaaaatctaaaaaagctgaaaagcaaaaatgatcgaaaagaggtacggaccaatgggacggtaagtggtattagaagagatcagaaagaaagctgaaaagcaaaacgattggaaagaggtacagtccgatggcatagaaagtaaatgtacaaagtacaaaagcagaaagtacatagaggaacaaaaatgtatgaagtggagtacagtccaatggcgtagtgaaaggctaataggcaagaaagaaaaacaaataagaattatcagatgaagtcagataaatgtttttcaagtctcataaaggtttgtagtgaagaataaagaagatagatgaatgaaatgaagttagtttaataggagaacggtaaaagaccgataacataaaagtaacaagctaacga

SEQ ID NO: 56674 - DNA, 269 bp, Homo sapiens
tatggaccgggggaacatccgaggcgctgaaaaaactcaacaagtaataaaaaactggtcaagaagctggccaagaagtatgatgcgtttttggcctcagagtctctgatcaagcagattccacgaatcctcggcccaggtttaaataaggcaggaaagttcccttccctgctcacacacaacgaaaacatggtggccaaagtggatgaggtgaagtccacaatcaagttccaaatgaagaaggtgttatgtctggctgtagctgttgg

SEQ ID NO: 56675 - DNA, 443 bp, Homo sapiens
  misc_feature 3, 10, 43, 259: n = A,T,C or G
acnttttganccagggaacctcggttttatggccgagaaggtntaaaggtgttttcattttcctgttcttacctattattgtatagagctattcatgccattttttgggaaaactttaaaaattgccccaaatactgacattgagtgcattaaataacaaattatctttgatacattaaacttttattcttcatgcatctgtaatttaattttaagtataatgttttgcctttggtacaactaaattaaaactcttggnggtcacatattgtatataaacaaaacaatatgctttgttgaaggaaaattttctttattggaatgtggttgtaatccttgttcagttcttaagtttcggttttttttaaaaacaggatgcaaccttaaacttttctttgcatcaaggtatatgcaaaacattggtgccgtgcatcaccaaatga

SEQ ID NO: 56676 - DNA, 224 bp, Homo sapiens
  misc_feature 32, 107, 110: n = A,T,C or G
gaaggccttgaggcagccagcgcaggggcttntgctgagggggcaggcggagcttgaggaaaccgcagataagtttttttctctttgaaagatagagattaatacanctncttaaaaaatatagtcaataggttactaagatattgcttagcgttaagtttttaacgtaattttaatagcttaagattttaagagaaaatatgaagacttagaagagtagcttg

SEQ ID NO: 56677 - DNA, 430 bp, Homo sapiens
  misc_feature 270, 348, 373: n = A,T,C or G
attcataaagtattttaactataggaactctagaagataatggttaggcaagtgattttttttttaaatatggttggcgtaagttgtattttgaaattcacttattttaaaatcgaagaggattgtaatcatggaaatagaatgtttgtatctacctgcccacattttcttaaaaagatatttcatatacagataatgaagaccaagctagtggctgcactgtaggtctgctgcttatttgtatttgttgggcttctgtttatgttgtanaagctgaaattctagcaacatgcttcaattctgttattttgatacttatgaaaatgtattaaggttttactatattgngcttttgaaagccataactcttaanaactttgtttttgcatattgtttgctaattctttactttaataaacctcaaaacccg

SEQ ID NO: 56678 - DNA, 181 bp, Homo sapiens
gtcccagccaatagaaaaatagactttgcagaaccccagcagtcagttgctgacatgagtatggaatccacaggaattccaggttactccttgctccggaaataaggaaaagcactaatatgaagtagatcttggcttcacccaacctgggagtgggaggaagtctgcctctgaacgccag

SEQ ID NO: 56679 - DNA, 286 bp, Homo sapiens
gttgttgcaatatttgattatccatttggttgttacagaaaaattcttaactgtaattgatggttgttgccgtaatagtatattgcctgtatttctacctctagtaatgggctttatgtgctagattttaatatccttgagcctgggcaagtgcacaagtctttttaaaagaaacatggtttacttgcacaaaactgatcagttttgagagatcgttaatgcccttgaagtggtttttgtgggtgtgaaacaaatggtgagaatttgaattggtccctcctattat

SEQ ID NO: 56680 - DNA, 379 bp, Homo sapiens
  misc_feature 4, 6, 327: n = A,T,C or G
cagnanaagattcccgagggtaaattatctttccaatccagaggaacaagcatgtctctctgccaagatccatctaaactggagtgatgttagcagacccagcttagagttcttctttctttcttaagccctttgctctggaggaagctctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcngccaaccaagatgcaaatgttttgaaatgatatgaccaaaattttaagtagg

SEQ ID NO: 56681 - DNA, 401 bp, Homo sapiens
gcatcaattttcgggaaatctttttgtttgtttatttaccagacatgttctaactttgtattgcccaaagtatattaaatacagatgtgtaatataaagcatcaatatcacctaacacatcgtatataagatataacatgatagatagttggtcgattacattgctatactgcttagttttaactggtttatttttattgtagcagaaatgaactgaaaaaaaatatgggtttgataatcacacacatgaaagtaccattttgtaactcaacaaaagataaaacattcttcatcaaaaggcttctcgcttggtgtcaggttgtcacatgtgaccactgtgcaatgcgaagccatacttcttcagtgcacaaagtcatgtttaaacttggaaaagagaatgc

SEQ ID NO: 56682 - DNA, 286 bp, Homo sapiens
  misc_feature 5: n = A,T,C or G
aggantacaaaacaaaaacactttaaaaactgaagatattactggtagtcatttcaaagtattcagatatggtttttttctttcattttctgcctttcctgatttttcttcaggacatttatattgattttgtactaagggaaaaactatggaacttaaaagatgtttttaaattaaaagagttaataacatttcagtaaacctacattttgttttccttttgtaattttattgtgcccatctagttgtaataacattttgcctttttgttaggtttcctaaagac

SEQ ID NO: 56683 - DNA, 448 bp, Homo sapiens
  misc_feature 3, 42: n = A,T,C or G
tanggaccggggaattcctgaagctgacagcattcgggccgngtatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatga

SEQ ID NO: 56684 - DNA, 329 bp, Homo sapiens
  misc_feature 328: n = A,T,C or G
attgctgttgttattttacaagggtctagggagagacccttgtttgattttagctgcagaacgtattggtccagcttgctcttcagtgggagaaaacacttgtaagttgctaaacgagtcaatcccctcattcaggaaaactgacagaggagggcgtgactcacccaagcatatataactagctagaagtgggccaggacaggccgggcgcggtggctcacgcctgtaatcccagcagtttgggaggtcgaggtaggtggatcacctgaggtcgggagttcgagaccaacctgaccaacatggagaaaccctgtctctattaaaaatnc

SEQ ID NO: 56685 - DNA, 370 bp, Homo sapiens
  misc_feature 144, 183, 335, 369: n = A,T,C or G
gaccggggaagtactaacatgggactaatctgtgggagcagtttattccagtatcacccagggtgcagccacaccaggactgtgttgaagggtgttttttttcttttaaatgtaatacctcctcatcttttcttcttacacagngtctgagaacatttacattatagataagtagtacatggnggataacttctacttttaggaggactactctcttctgacagtcctagactggtcttctacactaagacaccatgaaggagtatgtgctcctattattcctggctttgtgctctgccaaacccttctttagcccttcacacatcgcactgaanaatatgatgctgaaggatatggaagacacacatna

SEQ ID NO: 56686 - DNA, 152 bp, Homo sapiens
tatggcccgagcctatacaaaacaaaacaaaaacaaaacacacattaataaaacacaaaaaaccctggggaagggagagaattggatttcaagagttaccacattattaaattcaaatgtccaattttcaacaaaaaatcataaggcgtacg

SEQ ID NO: 56687 - DNA, 225 bp, Homo sapiens
  misc_feature 31: n = A,T,C or G
gaggccttgaggcagccagcgcaggggcttntgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatggg

SEQ ID NO: 56688 - DNA, 419 bp, Homo sapiens
  misc_feature 25, 417, 419: n = A,T,C or G
atggcgttttgtagtaaattctgtnaaatactttggtttaatttgtgactttttttgtaagaaattgtttataatatgttgcatttgtacttaagtcattccatctttcactcaggatgaatgcgaaaagtgactgttcacagacctcagtgatgtgagcactgttgctcaggagtgacaagttgctaatatgcagaagggatgggtgatacttcttgcttctcatgatgcatgtttctgtatgttaatgacgttgggtagctattaaggtactagagttgataaatgtgtacagggtccttttgcaataaaactggttatgacttgatccaagtgtttaacaattggggctgttaagtctgaccatacatcactgtgatagaatgtgggctttttcaagggtgaagatacaagtgntn

SEQ ID NO: 56689 - DNA, 139 bp, Homo sapiens
gaccgggaataaacaaaatgcccatgttggtcctctgccctggacctgtgacattctggactatttctgtgtttatttgtggccgagtgtaacaaccatataataaatcacctcttccgctgttttagctgaagaatta

SEQ ID NO: 56690 - DNA, 377 bp, Homo sapiens
  misc_feature 5, 28: n = A,T,C or G
gaacncggtggtggccctgcgcagaccntacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctg

SEQ ID NO: 56691 - DNA, 128 bp, Homo sapiens
  misc_feature 6, 94: n = A,T,C or G
gatacntctctttttttgctgttccaccaaatacaattcaaatgctttttgttttatttttttaccaattccaatttcaaaatgtctcaatggngctataataaataaacttcaacactctttatgat

SEQ ID NO: 56692 - DNA, 178 bp, Homo sapiens
  misc_feature 30, 32: n = A,T,C or G
gatgccgaaatgagttaagactttgggggntngttaggaaggcatgactagtttgagaacattatactcaatgaaataagccagtcaaaaaggaaaaatatgtattgtataaactaacttacattagtctaccacataggattaaaactgttcacaggaatataaaatagaatttttc

SEQ ID NO: 56693 - DNA, 380 bp, Homo sapiens
  misc_feature 2, 5, 29, 377: n = A,T,C or G
cnagnacagtaaactattttaggaagtcnacccccattgcactctgtggcagttattctggtaaaaataggcaaaagtgacctgaatctacaatgatgtcccaaagtaaccaagtaagagagattgtaaatgataaaccgagctttaaaggataaagtgttaataaagaaaggaagctgggcacatgtcaaaaagggagatcgaaatgttaggtaatcatttagaaaggacagaaaatatttaaagtggctcataggtaatgaatatttctgacttagatgtaaatccatctggaatctttacatcctttgccagctgaaacaagaaagtgaagggacaatgatatttcatggtcagtttattttgtaagagacagnaga

SEQ ID NO: 56694 - DNA, 161 bp, Homo sapiens
  misc_feature 6, 18: n = A,T,C or G
gacatngtggctgaaaancggctcatcccatatggctgtggggtcaagtacatccccagtcgtggccctctggacaagtggcgggccctgcactcatgagggcttccaatgtgctgcccccctcttaatactcaccaataaattctacttcctgtccaccg

SEQ ID NO: 56695 - DNA, 297 bp, Homo sapiens
tgtcaaatgacttttatccatcaattaataaaatcttatgatttttcttctttagtctgttaatatggtaaattacattgattgagttttgaatgttgaaccagccttgcatatctggaggaagaagtcccacttggccatggtttataatcctttttatacattgtcgaattcaatttactaatgttttattgaggatttttgcatctgtgttcatgagagatactggtctgtatctggtaatctgtattcctttctggtaatatatttttttcattaaatttttttattgacaat

SEQ ID NO: 56696 - DNA, 181 bp, Homo sapiens
gctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagga

SEQ ID NO: 56697 - DNA, 473 bp, Homo sapiens
  misc_feature 472: n = A,T,C or G
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataattttgaaggcgatcttttaaaaagagattaaaccgaaggng

SEQ ID NO: 56698 - DNA, 406 bp, Homo sapiens
  misc_feature 56: n = A,T,C or G
aagtgcatatttattaaaatagattgcatgttgtaatacggttttctgaaaggggnctcattgactattaaataaatgactactactaaacttgtctgtagtcattaatcttaaaattacctgaaaatctgatgacagttgccttccctaactttaatgtattaggttggcacaaaattaattgtagtttttgccactattaatggcaaaaaccgcaattatttttgtaccaacataatacacctttcatattatgtattatcttgcttaatgggttttatcttgattatccagttacttccatcctcttcccaatgttaatttgcaatagttttaaaatgggaacaaatgaatcaatcatcagatagttaaaatgaaattaaatcagctgcctaataatttatgg

SEQ ID NO: 56699 - DNA, 129 bp, Homo sapiens
gtagaaggtggagatgctggcaacagggaggaccagatcaacaggcttattagaagaatgaactaaggtgtctaccatgattatttttctaagctggttggttaataaacagtacctgctctcaaattg

SEQ ID NO: 56700 - DNA, 266 bp, Homo sapiens
  misc_feature 25: n = A,T,C or G
atcgatgaaattgagaccataatcngtgttaagctccagctcattggaattgtcggtattggaattgcaggtctgacgatctttggcatgatattcagcatggtcctctgctgtgcgatacgaaactcacgagatgtgatatgaagctacttctacatgaaaattgcaatctaaagctttcataccaaatgtcacaggagctgtctcccagctcatttttaacactgaaatgacattaggatctaaaataatttgctgtcaattga

SEQ ID NO: 56701 - DNA, 430 bp, Homo sapiens
cctcggtccttacagccgctcgtcagactccagcagccaagatggtgaagcagatcgagagcaagactgcttttcaggaagccttggacgctgcaggtgataaacttgtagtagttgacttctcagccacgtggtgtgggccttgcaaaatgatcaagcctttctttcattccctctctgaaaagtattccaacgtgatattccttgaagtagatgtggatgactgtcaggatgttgcttcagagtgtgaagtcaaatgcatgccaacattccagttttttaagaagggacaaaaggtgggtgaattttctggagccaataaggaaaagcttgaagccaccattaatgaattagtctaatcatgttttctgaaaatataaccagccattggctatttaaaacttgtaatttttttaatttacaaaaatat

SEQ ID NO: 56702 - DNA, 267 bp, Homo sapiens
  misc_feature 242: n = A,T,C or G
agaaatccatatcttaaagaaacagctttcaagtgcctttctgcagtttttcaggagcgcaagatagatttggaataggaataagctctagttcttaacaaccgacactcctacaagatttagaaaaaaagtttacaacataatctagtttacagaaaaatcttgtgctagaatactttttaaaaggtattttgaatactattaaaactgctttttttttccagcaagtatccaaccaactnggttctgcttcaataaatctttggg

SEQ ID NO: 56703 - DNA, 374 bp, Homo sapiens
acgattatctcttcaagctcctgctgatcggcgactcgggggtaggcaagacctgcctcctgttccgcttctcagaggacgccttcaacaccaccttcatctccaccatcggaattgattttaaaattagaacgatagaactagatggaaagaaaattaagcttcagatatgggacacagcgggtcaggaaagattccgaacaatcacgacagcgtactacagaggagccatgggcattatgctggtctatgacatcacaaatgaaaaatcctttgacaatattaaaaattggatcagaaacattgaagagcatgcctcttccgatgtcgaaagaatgatcctgggtaacaaatgtgatatgaatgacaaaaga

SEQ ID NO: 56704 - DNA, 297 bp, Homo sapiens
  misc_feature 7, 33: n = A,T,C or G
gaaagcngtggtcaataaattgattccagtatncattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctggaaaagccactggggacgagacaggtgctaaagttgaacgagctgatggatatgaaccaccagtccaagaatctgtttaaagttcagacttcaaatagtggcaaataaaaagtgctatttgtga

SEQ ID NO: 56705 - DNA, 215 bp, Homo sapiens
atagtgaagatgaaaaagaagatcataaaaatgtgcgccaacaacggcaggcggcatctaaagcagcttctaaacagagagagatgctcatggaagatgtgggcagtggggaagaacaagaagaggaggatgaggcaccattccaggagaaagattccggcagcgatgaagatttcctaatggaagatgatgacgatagtgactatggcagttcg

SEQ ID NO: 56706 - DNA, 437 bp, Homo sapiens
  misc_feature 15, 29, 42: n = A,T,C or G
gaaccgggaaagaanaaagataaccaagnacaaggtaaatgntctggatggtatcccgttgatcctggacaactgcaacatcagtgacagtaacccctttctgacccagtgggtgatatatgccatccgaaaccttaccgaagacaacagccaaaaccaagatttgattgcaaagatggaggaacaggggctggcagatgcatccctacttaaaaaagtgggttttgaagttgaaaagaaaggcgaaaagctgatcctgaaatctactagagacacccctaagccatgaatgaactacatccaaatacctgaatttttggaatctgtttcatggatttttcatcttctaccgtatgtgaaattgcaagtgtttgaagatttataagtacaaatttgggaacatacaaatcttttaggtagtagagtttaacgtgtat

SEQ ID NO: 56707 - DNA, 136 bp, Homo sapiens
  misc_feature 7: n = A,T,C or G
attttanggcagttaaattatctctgtattgtgaactaagactttctagaattttacttattcattctgtacttaaattttttctaatgaacacatatacttttgtaatcagaaaatattaaatgcatgtattttt

SEQ ID NO: 56708 - DNA, 359 bp, Homo sapiens
  misc_feature 31, 33: n = A,T,C or G
aactgccataggaatcatgtctggtcgcggntnaggcggaaaaggcttggggaagggtggtgctaagcgccatcgtaaggtgctccgggataacatccagggcattacaaaaccggctattcgccgtttggctcggcgcggtggcgtcaagcgcatttccggtcttatctatgaggagactcgaggtgtgcttaaggttttcttagagaacgttattcgagacgccgtcacctatacggagcacgccaagcgcaaaactgtcacagccatggatgtagtatatgccctgaaacgtcaggggcgcactctgtatggcttcggcggctgaatctaagaatacgcggtctcctgagaacttc

SEQ ID NO: 56709 - DNA, 248 bp, Homo sapiens
  misc_feature 2, 19, 34, 47: n = A,T,C or G
tnatggaccggggtcacanccagccaaacttagnatctcagtacaantcataactcttatgctcaaaccatgaccttgggcaactacactgtgtctttaattaatacatgtaaaaactgatcagaatggagctcagaacctgatatacatgcaatagctgttggttattattattgccagtcatagtgttggcaattatgtctcaatttccttttctaacaaatagaaaaccaaaactggtcttgctc

SEQ ID NO: 56710 - DNA, 330 bp, Homo sapiens
gagttccctggatttttggaaaatcaaaaagaccctctggctgtggacaaaataatgaaggacctggaccagtgtagagatggcaaagtgggcttccagagcttcttttccctaattgcgggcctcaccattgcatgcaatgactattttgtagtacacatgaagcagaagggaaagaagtaggcagaaatgagcagttcgctcctccctgataagagttgtcccaaagggtcgcttaaggaatctgccccacagcttcccccatagaaggatttcatgagcagatcaggacacttagcaaatgtaaaaataaaatctaactctcatttg

SEQ ID NO: 56711 - DNA, 480 bp, Homo sapiens
  misc_feature 464: n = A,T,C or G
ggagtccgacgtggaagttgctggctgactgggcttgcgaggaaaccgcctcggagctgcagccgaaggccaaggaatcactgaagatcggcgagggaggacagggggttcatcatgggtggctttttctcaagtatattttccagtctgtttggaactcgggaaatgagaattttaattttgggattagatggagcaggaaaaaccacaattttgtacagattacaagtgggagaagttgttactactatacctaccattggatttaatgtagagacggtgacgtacaaaaaccttaaattccaagtctgggatttaggaggacagacaagtatcaggccatactggagatgttactattcaaacacagatgcagtcatttatgtagtagacagttgtgaccgagaccgaattggcatttccaaatcagagttagttgccatgttggaggaagaagagctganaaaagccattttagtg

SEQ ID NO: 56712 - DNA, 465 bp, Homo sapiens
  misc_feature 40: n = A,T,C or G
tctgccattcaactcggaaaactataagtaattctcaagnaaagccctcatttttataacctggcaaaatcttgttaatgtcattgctaaaaaaataaataaaagctagatactggaaacctaactgcaatgtggatgttttacccacatgacttattatgcataaagccaaatttccagtttaagtaattgtctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaatttccaggaaaaaataaaaagagtatgagtcttctgtaattcattgagcagttagctcatttgagataaagtcaaatgccaaacactagctctgtattaatccccatcattactgg

SEQ ID NO: 56713 - DNA, 486 bp, Homo sapiens
  misc_feature 1, 17, 19, 33: n = A,T,C or G
natggccaggagggcangnagtacaccaatttnttaaaagcaaggaaaccacagtgtctcttcactagtcatttagaacatggttatcatccaagactactctaccctgcaacattgaactcccaagagcaaatccacattcctcttgagttctgcagcttctgtgtaaatagggcagctgtcgtctatgccgtagaatcacatgatctgaggaccattcatggaagctgctaaatagcctagtctggggagtcttccataaagttttgcatggagcaaacaaacaggattaaactaggtttggttccttcagccctctaaaagcatagggcttagcctgcaggcttccttgggctttctctgtgtgtgtaggttttgtaaacactatagcatctgttaagatccagtgtccatggaaacattcccacatgccgtgactctggactatatcagtttttggaaagcagggttcctctgcctgctaac

SEQ ID NO: 56714 - DNA, 303 bp, Homo sapiens
  misc_feature 64: n = A,T,C or G
aaccggggaatacccatattctttaatgtgagcaaggtttgcaagtagctttttcaactgtgcnaatgcccaactccttctacaagtggaacccttgatttaaaaccaacccattgattctagttattaaagtaaaacaatagtttcaattcctaatgtagtatgaagagacccctttgaaccatttcacagaattttaagaattaatacttgtagagaagtgatatcatgacaacatcaatgtagtatctttatgcatctgtgagaatttggtttttaaaaaatatattccttagaaagcct

SEQ ID NO: 56715 - DNA, 465 bp, Homo sapiens
  misc_feature 433: n = A,T,C or G
atattcatttccttgcatttaagaaaatatgaaagcttaaggaattatgtgagcttaaaactagtcaagcagtttagaaccaaaggcctatattaataaccgcaactatgctgaaaagtacaaagtagtacagtatattgttatgtacatatcattgttaatacagtcctggcattctgtacatatatgtattacatttctacatttttaatactcacatgggcttatgcattaagtttaattgtgataaatttgtgctgttccagtatatgcaatacactttaatgttttattcttgtacataaaaatgtgcaatatggagatgtatacagtctttactatattaggtttataaacagttttaagaatttcatccttttgccaaaatggtggagtatgtaattggtaaatcataaatcctgtggtgaatggnggtgtactttaaagctgtcaccatgttatatt

SEQ ID NO: 56716 - DNA, 484 bp, Homo sapiens
  misc_feature 6, 7, 30, 31, 309, 445, 469, 481: n = A,T,C or G
gtggcnngtgattcttgttttcagaagggnnagtggtatagatagaaaatgacaaagcatggcaatatacacttaatgttgttattgtatgttgttactgaagtacttagatttttaaaatttcaaatcctaaatcacttcttgtaggagggttttcattaactacagtatatacagttcactacatatgggttgtttgagttttttgtgtgctgtatttctttctgttttttaatacctggttttgtacatatctaactctgttctcttttggttgttcagaaactggatttttttttcttaagcagngcttaatttgtgttttttaattttgattcagaagtagtcccagctcataggtgttcatactgttacatccagaacatttgtcaggctctctgtcagctttcatgtacatatggtatagaaaccatggagttaggcncttcctggattttttttttatganaaaaatactgtnttt

SEQ ID NO: 56717 - DNA, 312 bp, Homo sapiens
gctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaaattgtattgaaaacacttagtatgcagttgataagaggaatttggtataattatggtgggtgattattttttatactgtatgtgccaaagctttactactgtggaaagacaactgttttaataaaagatttacatt

SEQ ID NO: 56718 - DNA, 481 bp, Homo sapiens
  misc_feature 55, 87, 89, 94, 139, 148, 172, 185, 211, 282, 327, 388, 393,456: n = A,T,C or G
ggggcccttccttcctttttgatttagtgaatggcatttgctggttataacagcnaatgaaagactcttcactccaaaaagaaaagngntttgntttttaattctctggtccttttgcaaacaattttaatgatggggntaaagctgnacaccccaggacagtttatcctgnctgaggagtaagngtacaattgatcttttttaattcagnacaacccataatcatgtaaatgctcattttctttaggacataaagagagccctagggtgctctgaatctgnacatgttcttgtcataaaatgcatactggtgatacaaaccactgngaacattttttatttgagaattttgtttcaaagggattgctttttcctctcattggcttgntatgnacaaactagtttttatagctatcaacattaggagtaactttcaaccttgccagcatcactggnatgatgtatatttaattaaagcaca

SEQ ID NO: 56719 - DNA, 336 bp, Homo sapiens
  misc_feature 295, 307, 329, 336: n = A,T,C or G
acgatgaccttgaataaaaattgcacacactcagtgcagcaatatattaccagcaagaataaaaaagaaatccatatcttaaagaaacagctttcaagtgcctttctgcagtttttcaggagcgcaagatagatttggaataggaataagctctagttcttaacaaccgacactcctacaagatttagaaaaaagtttacaacataatctagtttacagaaaaatcttgtgctagaatactttttaaaaggtattttgaataccattaaaactgcttttttttttccagcaagtntccaaccaactnggttctgcttcaataaatcttnggaaaan

SEQ ID NO: 56720 - DNA, 263 bp, Homo sapiens
atagcacatcattcctcctatagggatgaactttttcctggcacgaaaagtagccgctctggttgaagctttgcttattgtaacaggcttttatttccaggtaatatgtcttggaagacttaattctgattagagatatagatattactggaaactaattgttttttttctattgtactctgctttatcaaagaagtaaaacatttaaatcgtactacagaaattaagatgttgtcttgcgatccttaataaatgaatgattt

SEQ ID NO: 56721 - DNA, 281 bp, Homo sapiens
taattaattttacactctaatggtagttgatcttcatagtcaagaggcactgttcaagatcatgacttagtgtttcaatgaaatttgaaaagggactttaaaacttatccagtgcaactcccttgtttttcgtcagaggaaaaggaggcctagaaaggttaagtaacttggtcgagaccactcagccttgagatcaagaaaacctaatcttctgactcccaggccaggatgttttatttctcacatcatgtccaagaaaaagaataaattatgttcagctc

SEQ ID NO: 56722 - DNA, 442 bp, Homo sapiens
  misc_feature 177, 390: n = A,T,C or G
ctgctgtccgcaccgttccacagcataaatatgctgcaggagttcgcaatcctcagcaacatcttaatgcacagccacgagttacaatgcaacagcctgctgttcatgtacaaggtcaggaacctttgactgcttccatgttggcatctgcccctcctcaagagcaaaagcaaatgntgggtgaacggctgtttcctcttattcaagccatgcaccctactcttgctggtaaaatcactggcatgttgttggagattgataattcagaacttcttcatatgctcgagtctccagagtcactccgttctaaggttgatgaagctgtagctgtactacaagcccaccaagctaaagaggctgcccagaaagcagttaacagtgccacccggngttccaactgtttaaaattgatcagggaccatgaaaagaaacttgtgcttca

SEQ ID NO: 56723 - DNA, 339 bp, Homo sapiens
aaaggtacagaggggcaccatttgtattgtcacacaacaatgatcagaatgatcagtttagaatgatcagaacaaaaacaccactctttaatgggtctttttcttggctagaagtctttcctcagtttttgttgactatcatacgctgatttgtgggtgatggaagggggctagagataacgtttctctgtactttggtaaaggatgaaggagtcagagagggaacagaaaaagtgagagagtggcctgctgaaataatagcctgcctctaaaagttgtgaccagaaagtatgattcatttgggcccagagggaataaaatatgttttttcatatacct

SEQ ID NO: 56724 - DNA, 283 bp, Homo sapiens
  misc_feature 230, 248, 251, 283: n = A,T,C or G
aagttgcaagccaacaaaaaagttcaaggatctagaagacgattaagggaaggtcgttctcagtgaaaatccaaaaaccagaaaaaaatgtttatacaaccctaagtcaataacctgaccttagaaaattgtgagagccaagttgacttcaggaactgaaacatcagcacaaagaagcaatcatcaaataattctgaacacaaatttaatattttttttttctgaatganaaacatgagggaaattgnggngttagcctcctgtggtaaaggaattgaggaan

SEQ ID NO: 56725 - DNA, 427 bp, Homo sapiens
ggaaagcgaattggcaccaaagcagcagctgttttgccgcagttctagcttcaccttcacgatgtttcccttggtcaaaagcgcactaaatcgtctccaagttcgaagcattcagcaaacaatggcaaggcagagccaccagaaacgtacacctgattttcatgacaaatacggtaatgctgtattagcctagtggagccactttctgtattgttgcatggacatatgtagcaacacaagtcggaatagaatggaacctgtcccctgttggcagagttaccccaaaggaatggaggaatcagtaatcatcccagctggtgtaataatgaattgtttaaaaaacagctcataattgatgccaaattaaagcactgtgtacccattaagatatggcattattgaagaaataaagtacatttgaaacctt

SEQ ID NO: 56726 - DNA, 201 bp, Homo sapiens
caagaccagcctgaccaacatggagaaaccctatctctactaaaaatacaaaattagccaggtgtggtggtgcctgcctgtaatcccagctactcggaatgctgaggcaggagaatcgcttgaacccaggaggcagaggttgtggtgagccgagatcacgccattgcacttcagcctgggcaacaagagcgaaacttcatc

SEQ ID NO: 56727 - DNA, 277 bp, Homo sapiens
  misc_feature 7, 31: n = A,T,C or G
atggacnctaaaaatactacattgatctaantaagaaactagccttgtggagtatatagatgcttttcattatacacacaaaaatccctgagggacattttgaggcatgaatataaaacatttttatttcagtaacttttccccctgtgtaagttactatggtttgtggtacaacttcattctatagaatattaagtggaagtgggtgaattctactttttatgttggagtggaccaatgtctatcaagagtgacaaataaagttaatgatgattcc

SEQ ID NO: 56728 - DNA, 202 bp, Homo sapiens
tcatattttccatcttattcccaattaaaagtatgcagattatttgcccaaatcttcttcagattcagcatttgttctttgccagtctcattttcatcttcttccatggttccacagaagctttgtttcttgggcaagcagaaaaattaaattgtacctattttgtatatgtgagatgtttaaataaattgtgaaaaaaatg

SEQ ID NO: 56729 - DNA, 129 bp, Homo sapiens
  misc_feature 20, 21, 41, 43: n = A,T,C or G
gaccgggaaggaatccggannacggaaaatgtccgaaggcntnagtacttgaccctgtattttgggagtcgaacggagaatggaaactgaaagtggaaatcaggaaaaggtaatggaagaagaaaacac

SEQ ID NO: 56730 - DNA, 284 bp, Homo sapiens
  misc_feature 6, 22, 30: n = A,T,C or G
agtgangcgaaatgcagtaagnacgaagtntgtctgtacttgagagtagagtctgctcatttttgtattcctagcctgctgcaactcttgacatgtagcaaacattcaaaagctgttgactgaatgaaaaacagtttctgagattgcatataaaaattaaaaattggccagacccggtggctcaggcctgaaatctcagcattttgggaggccaaggcaggcagatcacttgagcttaggaattcgaggctatcctgggcaacatggtgaaaacccatctctac

SEQ ID NO: 56731 - DNA, 444 bp, Homo sapiens
  misc_feature 24: n = A,T,C or G
caggctcgccgacttgcccctaantttcgatgggccatacccaataggcagatcaatgatgggatgggtggagatggagatgatatggaaatattcatggaggagatgagagaaatcagaagaaaacttagggagctgcagttgaggaattgtctgcgtatccttatgggggagctctctaatcaccatgaccatcatgatgaattttgccctatgccttgactcctgccatttatcatgagattaatactgtgattcccgctgttttctttttccttgcattttcctaatatgcctttactgatccgtttgctgtgaaccctatgttatttccatgtgtcaagtgggtcttgtgttgccagcttctatttgaagattgcctttgcactcagtgtaagtttctgtcagcagtagtttcacccatttgcatggaaaaatttaaag

SEQ ID NO: 56732 - DNA, 336 bp, Homo sapiens
  misc_feature 24, 167, 259: n = A,T,C or G
tacctggaggtcaatcaacttganaagtttgacataaagagcttctgcaagatcctggggccattatcctactccaagatcaagcatttgcgtttggatggcaatcgcatctcagaaaccagtcttccaccggatatgtatgaatgtctacgtgttgctaacgaagncactcttaattaatatctgtatcctggaacaatattttatggttatgtttttctgtgtgtcagttttcatagtatccatattttattactgnttattacttccatgaattttaaaatctgagggaaatgttttgtaaacatttattttttttaaagaaaagatgaaagg

SEQ ID NO: 56733 - DNA, 486 bp, Homo sapiens
  misc_feature 389, 439: n = A,T,C or G
gctgagggggcaggcggagcttgcggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggngattaaaataatttgaaggcgatcttttaaaaagagattaaaccgaaggngattaaaagaccttgaaatccatgacgcagggagaattgcgtcattt

SEQ ID NO: 56734 - DNA, 276 bp, Homo sapiens
cacaggcagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaatt

SEQ ID NO: 56735 - DNA, 490 bp, Homo sapiens
  misc_feature 5, 30: n = A,T,C or G
gctgncccagcactttgataaacttggacnttattctttggctttggattatattaatgctgcaattgctagtactccaactctaatagaattattctatatgaaagcaaaaatttacaagcatataggtaatctcaaagaagctgcaaagtggatggatgaagcacagtctttggacacagctgatagattcatcaattccaaatgtgcaaaatacatgcttcgagcaaatatgataaaagaagcagaggaaatgtgctccaagttcacaagggaaggaacatctgccatggaaaatctaaatgaaatgcagtgtatgtggtttcagacagaatgcatttcagcttatcagcgtctggggagatacggggatgccttgaaaaaatgtcatgaagtagaaaggcatttttttgagataactgatgaccaattcgacttccatacatactgcatgagaaagatgacccttcgtgcctatgttgaccttttg

SEQ ID NO: 56736 - DNA, 238 bp, Homo sapiens
  misc_feature 6, 32, 33, 234: n = A,T,C or G
aactancaaaaaatggatatccgtatacacanntagtaaaactggattcctatatctcaccatatataaaaattaactcaagattgattaaatactcaaatgtaaaaacctatacaattcctagaagaaaacctaggaaaactttactgaatatcagccttgacaaagaatttatgactaagtcatcagaagcaaatgaaacaaaaataataataggcaaatgggacctaagtnaact

SEQ ID NO: 56737 - DNA, 442 bp, Homo sapiens
caactcagtgattgtgggaaacactcatgggcagctggcagaaattgaccttcggcaagggcgtctactgggctgtctgaaggggctggcaggcagtgtgcgtgggttgcagtgccacccttcaaagcctctactagcctcctgtggcttggacagagtcttgaggatacacaggatccagaatccacggggtctggagcataaggcagggacaactgggaggatgagccccaagagcctcaagaacccaacaaggtgcccctagaagacacagagacagatgaactttgggcatccttggaggcagctgccaagcggaagctctcgggtttggagcagccccaaggagctctccaaacgagacggagaaagaagaagcggcctgggtccaccagcccctgacgtccctgtgcccactttgtaaataaactgctgaacaccc

SEQ ID NO: 56738 - DNA, 499 bp, Homo sapiens
  misc_feature 469: n = A,T,C or G
gttccaaggcatctgtgagcccgcggagtatacaccatgagcaaagctcaccctcccgagttgaaaaaatttatggacaagaagttatcattgaaattaaatggtggcagacatgtccaaggaatattgcggggatttgatccctttatgaaccttgtgatagatgaatgtgtggagatggcgactagtggacaacagaacaatattggaatggtggtaatacgaggaaatagtatcatcatgttagaagccttggaacgagtataaataatggctgttcagcagagaaacccatgtcctctctccatagggcctgttttactatgatgtaaaaattaggtcatgtacattttcatattagactttttgttaaataaacttttgtaatagtcaaaaatgctttctcagatgttctgaatatagaatatcagctctcattccagttttttctaacatgaattttcctggntgacattgatttcaaagggttttatgcatt

SEQ ID NO: 56739 - DNA, 475 bp, Homo sapiens
  misc_feature 29, 30: n = A,T,C or G
gtaagcgctgaggatttttggtccgcacnnttctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcttaagtcaactatttta

SEQ ID NO: 56740 - DNA, 490 bp, Homo sapiens
gattacgcttagaggtgaacagtaaaggtttttatgttatcttttcaaaacttaatagacatttaaccatcataagcttgtcccccctcaaaatcatgattgacaagactaaataaaatgtatatcaggtgtctctttatggaggaaattgtagtaggatttatttaaaggatcaatatttaaatagccctatgccaattatcataaataattaaggacatgatattcctagctttcctgatttacatggaagtacgttaaatagtcacatctccaaaatttttcttgaatagttgtctttaaaaatgtgtttacatttgtaaggatcttcataaacagaaggggtaattcaaagatgggcatggaattgacttatgccaattgattaaaacaaacaaagaggaataattccattgaaccttgattctggaaactttgatccacccagcagtcatgatgttagactcattgaaaagaatgtatttctaat

SEQ ID NO: 56741 - DNA, 451 bp, Homo sapiens
  misc_feature 7: n = A,T,C or G
gacccgnacaaaacagccctgcaaagagctattgacaaaattaaagtggaattttcaattaatctggtcaactttctgtggttagtttgtatacttgccatctaaaaataattgacatcccagtaacaataatgacaaagatgatgaatatttaagaagtacttacggccgggcctggtggcttatgcctacaatcccagcactttgggaagcctaggtgggctgatcaccttaggtcaggagttcaagactagcctggccaacatggtgaaaccctgtctctgctaaaaatacaaaaattagccgggcatggtggcaggcacctgtagtcccagctactcaggagcctgagacaggaggatcacttgaacccgggaggcggaggttgcagtgagacaagattgcacgccattgccctccagcctgggcaacagagcaagactccgtcgta

SEQ ID NO: 56742 - DNA, 344 bp, Homo sapiens
  misc_feature 7, 31: n = A,T,C or G
gatgccnccactcattttgagacaacgtgtnatgacattaaaaacatctataagaggatgacaggatcagagtttgactttgaggaaatgaagcgcaagaagaatgacatctatggggaagactaacagcagtacatgttattatgtaattaggacacatttaaaatttggcaaataatgcatataatgaaatcaatattgtaaggcctgcttttgtaatgaaaatggagagaatgaagagcgctgtgccagtaaatactccccttcacctttctaattattaacttgttttcatggagtggctattcagcattggcagttaccacattctgttcaatttaacc

SEQ ID NO: 56743 - DNA, 477 bp, Homo sapiens
  misc_feature 2, 16, 40: n = A,T,C or G
tntggaccggggacanctcggtggtggccactgcgcagtnttttacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggcagggaaggaaagaacttgcatgttggtgaaggaagaagtggggtggaagaagtg

SEQ ID NO: 56744 - DNA, 210 bp, Homo sapiens
  misc_feature 18: n = A,T,C or G
gaggtcaagcgatcgagnatcgtcctagcctcatggtgaaaccctgtctttactaaaaatacaaaaattatctgggcatggtagtgggcacctgttgtcccagctacttgagagactgaggcagaattgcttgaacccaggaggcagaggttgcaagtgaaccaagattgcaccactgcactccagtctggcaacagagcgagactttgt

SEQ ID NO: 56745 - DNA, 345 bp, Homo sapiens
  misc_feature 104, 143: n = A,T,C or G
gtttattccagtatcacccagggcgcagccacaccaggactgtgttgaagggtgttttttttcttttaaatgtaatacctcctcatcttttcttcttacacagngtctgagaacatttacattatagataagtagtacatggnggataacttctacttttaggaggactactctcttctgacagtcctagactggtcttctacactaagacaccatgaaggagtatgtgctcctattattcctggctttgtgctctgccaaacccttctttagcccttcacacatcgcactgaagaatatgatgctgaaggatatggaagacacagatgatgatgatgatgatga

SEQ ID NO: 56746 - DNA, 301 bp, Homo sapiens
  misc_feature 5: n = A,T,C or G
gaagncctgggagtcatagaaaaaaagattttgtcccaaggagagtcatccactttgttagtggtgaaacaatggaagaatatagcacagatgaagacgaagttgatggcctggagaagaaagatgttttgcctactgttgatccgacaaaacttacctgggtccctacttatggttttacatgcttcgggctgctacatcaactctctcagtgtgtgacttccttggagagaagattgcatctgttttgggtatcagcaccccaaagtaccaatatgccattgatgaatattatcgggtg

SEQ ID NO: 56747 - DNA, 499 bp, Homo sapiens
ctacctgattttccctacaaagaacgacctcctggccttggactccagctgcctcctgttcattgttcttgtgttctttgccttattcatcatttttaaggcttatctaattaactgtgtttggaactgctataaatacatcaacaaccgaaacgtgccggagattgctgtgtaccctgcctttgaagcacctcctcagtacgttttaccaacctatgaaatggccgtgaaaatgcctgaaaaagaaccaccacctccttacttacctgcctgaagaaattctgcctttgacaataaatcctataccagctttttgtttgtttatgttacagaatgctgcaattcagggctcttcaaacttgtttgatataaaatatgttgtcttttgtttaagcatttattttcaaatactaaggagctttttgacatctgttaaacgtctttttgtttttttgttaagtcttttacattttaataggtttttggaagacaatctagg

SEQ ID NO: 56748 - DNA, 469 bp, Homo sapiens
  misc_feature 5, 30: n = A,T,C or G
ggggncccatgcaaagtttcagaaaatctnttattgaaaatttaatttagcctcatttttgacatagattttcttgttaaaaaaagggataaaagttttttggtgttctgttttccaggtttatggttggctgtgggagatgtgatgactggtttcatggtgattgtgttgggttaagtctttctcaagcacagcagatgggcgaggaagacaaagaatatgtctgtgtaaaatgttgtgctgaagaagacaaaaagactgaaatactagatccagatactttggaaaaccaagctacagttgaattccatagtggagataaaacaatggagtgtgaaaagcttggattatcaaaacacacaacaaatgatagaaccaaatatatagatgatacagtgaagcacaaggtcaaaattttaaaacgggagtctggtgaaggcagaaattcatcagactgtagagataatga

SEQ ID NO: 56749 - DNA, 477 bp, Homo sapiens
  misc_feature 18, 23, 117, 170, 280, 444, 447: n = A,T,C or G
caggacgctgatgcgttngggtnctcgtctgcagaccctctggacctggtcacgattccataatgtaccacaacagtagtcaggaagcggcactggaccttctccagcgaggagcangcttggcaagaactgcgggctggacgccaacccgcaaaattcatgatgcaaanccgtggccaacggggaagggtcttccgaatgatccagtctttcttgagcctcatgaggaaatgacactctgcaaatactatgagaaaaggttattggaattctgttcggngtttaagccagcaatgccaagatctgttgggggtaccggcttgtatgtatttcaaacgtttttatcttaataactcagtaatggaatatcaccccaggataataaatgctcacttgtgcattttttgggcctgcaaagtagatgaaattcaatgtatcctaggnccncagttttggtgggaaacctccgggagagtc

SEQ ID NO: 56750 - DNA, 100 bp, Homo sapiens
  misc_feature 21, 50, 74, 88: n = A,T,C or G
gctgagggggcaggcggagcntgaggaaaccgcagataagtttttttctntttgaaagatagagattaatccanctccttaaaaaatntagccaataggt

SEQ ID NO: 56751 - DNA, 266 bp, Homo sapiens
  misc_feature 182, 210: n = A,T,C or G
cggatgataatctacctcactttccctgtggctatgttctgggtttccaatcaggccgagtggtttgaggacgatgtcctacagcgcaagagggagctgtggccacctgagaagcttcaagagatagaggaattcaaagagaggttaccggaagcggcgggaggagaagctccttcgcgacncccagcagaactcctgaggcctccaagngggagtcctagcccctcccctgatgaaatatacatatactcagttccttgttattc

SEQ ID NO: 56752 - DNA, 236 bp, Homo sapiens
  misc_feature 153, 195: n = A,T,C or G
gacaaacctaccgagcctggggatagctggttgtccaagatagaatcttagttcaactttaaatttgcccacagaaccctctaaatccccttgtaaatttaactgttagtccaaagaggaacagctctttggacactaggaaaaaaccttgtngagagagtaaaaaatttaacacccatagtaggcctaaaagcngccaccaattaagaaagcgttcaagctcaacacccactacc

SEQ ID NO: 56753 - DNA, 487 bp, Homo sapiens
  misc_feature 9, 116: n = A,T,C or G
ggccccagnaataactaaaacgatctagtagaagaataaagcagttggaatcactctactgatattaaagctttcccttatagtgatagtaatcaagatacacagatcaatgcggnggaacagagaactaaaaaaatacataaatatgccaaattaatttttgacaaaggtgaaaaagcaattcactgatagattattcttcttaacaaatggtgttggagcagaaattggacatccatagacgaaatgatcaaccctgatctaaattttatattttatacaaaattaactcaaaatagattatggacataaatgtaaaattgtaaaactcttaggcaaaaaaggagaaagttagccaggtgtggtggctcatgcctgtaatcccagaactttgggaggccgaagtgggtggatcacctgaggtcgggagtttgagatcagcctgaccgacatggagaaacaccgtctctactaaaaatacaaaatc

SEQ ID NO: 56754 - DNA, 392 bp, Homo sapiens
  misc_feature 32: n = A,T,C or G
gaaggccttgaggcagccagcgcaggggcttntgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactactgagccccgaattaataccaatagaagggcaatgcttttagattaaaatgaaggtgacttaaac

SEQ ID NO: 56755 - DNA, 161 bp, Homo sapiens
  misc_feature 144: n = A,T,C or G
gacagcagttactgtggatttttaagagactcagttaaagaatttaggaatttctgattcatttaaaggatttacaaattcatcaacccctgaaaactaaagcaaattgaacaggaaaaaaaaaagaagatgggttttttaagnccaatatatgttatttt

SEQ ID NO: 56756 - DNA, 429 bp, Homo sapiens; identical to SEQ ID NO: 37572

SEQ ID NO: 56757 - DNA, 431 bp, Homo sapiens
aatatttttgttctattgttattaccaaaaattccactatgattgatgttcagtgattttctatagcaacttttttggtaactctttgggtttctgatttgttttagctaaaattttggggatatgatttgggtctttgattaatgtcagctgaacttggatttctagttcatgaagaaatctctcccaatacccatttatcctatttttagcaataattcgttaatgattccacttgattttcagaatattgtcctggttgattttgatttgacagcatacattatgaaatttgaaagtaggttaccattttgaggcagttggatataaattatgtaaatatgtatgattatgatttttataaatggcataacatgagtgtactaactaccttctatgctggccatgctacagattttctggaggtatga

SEQ ID NO: 56758 - DNA, 148 bp, Homo sapiens
  misc_feature 16, 25, 46: n = A,T,C or G
tatggaccgggggaanaggaacagnattgttcctaaaccagtaagnaggaggttgcccagaagaaaaagatatcccagaagaaactgaagaaacaaaaacttatggcacgggagtaaattcagcattaaaataaatgtaattaaaagg

SEQ ID NO: 56759 - DNA, 390 bp, Homo sapiens
  misc_feature 5, 31: n = A,T,C or G
agttngctgagatgaagctgagaccaagtcnacttcagaaatcttgaaggcaggcgcaaacgggcataaattccagggaccactgggtgagagaggaataaggcccagagcgaggaaaggattttaccaaagcatcaatacaaccagcccaaccatcggtccacacctgggcatttggtgagagtcaaagctgaccatggatccctggggccaacggcaacagcatgggcctcacctcctctgtgatttctttctttgcaccaaagacatcagtctccaacatgtttctgttttgttgtttgattcagcaaaaatctcccagtgacaacatcgcaatagttttttacttctcttaggtggctctgggaatgggagaggggtaggatgtac

SEQ ID NO: 56760 - DNA, 229 bp, Homo sapiens
  misc_feature 31, 32: n = A,T,C or G
gggtcacgttgaggtcaggagtttgagaccnnactgaccaacatggtgaaaccctgtctctaccaaaaaaagacaaaaattatctgggaatggtggcacacacctatagtcccagctacttgggaggctgaggtggaagaatcacttgggccccggaggtggaggttgcagtgagccgagattgcgccactgcactccagcctgtgtaacagagtgagacactgtctcc

SEQ ID NO: 56761 - DNA, 401 bp, Homo sapiens
  misc_feature 30: n = A,T,C or G
ggaggcgaacaatggcggactgggcgaatncgatgaagcggagttgcagcgcctggtggccgccgagcagcagaaggcgcagtttactgcacaggtgtatcacttcatggagttatgttgggataaatgtgtggagaagccagggaatcgcctagactctcgcactgaaaattgtctctccagctgtgtagaccgcttcattgacaccactcttgccatcaccagtcggtttgcccagattgtacagaaaggagggcagtaggccatcccccaggagaatgacagaagcaaaggacttgttactaagcagatttaagggtcagtgggggaaggctatcaacccattgtcagatcagcatcaggctgttatcaagtctgttggtgctaaaaagtaaaagatg

SEQ ID NO: 56762 - DNA, 477 bp, Homo sapiens
ggaagctctgtttggtgctttggatccatttcctcggtccttacagccgctcgtcagactccagcagccaagatggtgaagcagatcgagagcaagactgcttttcaggaagccttggacgctgcaggtgataaacttgtagtagttgacttctcagccacgtggtgtgggccttgcaaaatgatcaagcctttctttcattccctctctgaaaagtattccaacgtgatattccttgaagtagatgtggatgactgtcaggatgttgcttcagagtgtgaagtcaaatgcatgccaacattccagttttttaagaagggacaaaaggtgggtgaattttctggagccaataaggaaaagcttgaagccaccattaatgaattagtctaatcatgttttctgaaaatataaccagccattggctatttaaaacttgtaatttttttaatttacaaaaatataaaatattgaagacat

SEQ ID NO: 56763 - DNA, 259 bp, Homo sapiens
  misc_feature 6, 31: n = A,T,C or G
gtacanacgagtcctggccttgtctgtgganacggattacaccttcccacttgctgaaaaggtcaaggccttcttggctgatccatctgccaccacagctgctcctgctgctgctgcagccccagctaaggttgaagccaaggaagagtcggaggagtcggacgaggatatgggatttggtctctttgactaatcaccaaaaagcaaccaacttagccagttttatttgcaaaacaaggaaataaaggcttacttcttt

SEQ ID NO: 56764 - DNA, 418 bp, Homo sapiens
  misc_feature 3, 5, 45: n = A,T,C or G
tangnaccgggaatgtcctcttgtcagcctgtctttcagaagtanctggtggggcaagtccgtgggcatcatgttgaccgagctggagaaagccttgaactctatcatcgacgtctaccacaagtactccctgataaaggggaatttccatgccgtctacagggatgacctgaagaaattgctagagaccgagtgtcctcagtatatcaggaaaaagggtgcagacgtctggttcaaagagttggatatcaacactgatggtgcagttaacttccaggagttcctcattctggtgataaagatgggcgtggcagcccacaaaaaaagccatgaagaaagccacaaagagtagctgagttactgggcccagaggctgggcccctggacatgtacctgcagaataataaagtcatcaata

SEQ ID NO: 56765 - DNA, 338 bp, Homo sapiens
  misc_feature 2, 20, 215: n = A,T,C or G
anatggacccggggaaattncattgtgcaatgccattaagaaacccattccagctgtcatggtatgttacaaggttttcagcagactttgctcctaatggctctctgaaagtgacagacttaaatattgctctgcagtgcttttcagaatgtagagtgagacctctggtggaaaaattattgccctgtggactcctttaattttttttacattanacgaagcttctcctgtctgtaaaggaatgctataagaaatttcaaacacaggttttgcggaattttaaatgctggaaaacataaatgaaatgcctaaatatattgttacagattttaatactg

SEQ ID NO: 56766 - DNA, 405 bp, Homo sapiens
catgtcactttttaagatttaaatttaaattagttaacattcaaaacgcagctccccaatcacactagcaacatttcaagtgcttgagagccatgcatgattagtggttaccctattgaataggtcagaagtagaatcttttcatcatcacagaaagttctattggacagtgctcttctagatcatcataagactacagagcacttttcaaagctcatgcatgttcatcatgttagtgtcgtattttgagctggggttttgagactccccttagagatagagaaacagacccaagaaatgtgctcaattgcaatgggccacatacctagatctccagatgtcatttcccctctcttattttaagttatgttaagattactaaaacaataaaagctcctaaaaaat

SEQ ID NO: 56767 - DNA, 112 bp, Homo sapiens
  misc_feature 38: n = A,T,C or G
gcattcctagtttctatatagtgcaatagtagcatagnattctataaattcttacttgtctaagacaagtaaatctgtgttaaacaagtagtaataaaagttaattcaatct

SEQ ID NO: 56768 - DNA, 182 bp, Homo sapiens
  misc_feature 46: n = A,T,C or G
tatggaccggggaaatgctttaagaaaaaaaaagtgtaatttgctnagaataattcatgatctgtttatgcgataactcctttttgttacaatttttttaaaaaaagctatttttgttaatgtaaagtaaatatttcagagcaaattttttaaacttattgcactaaatacaggctctgtgc

SEQ ID NO: 56769 - DNA, 148 bp, Homo sapiens
  misc_feature 9: n = A,T,C or G
atcaccagnaaaagtctttaactccaccattagcacccaaagctaagattctaatttaaactattctctgttctttcatggggaagcagatttgggtaccacccaagtattgactcacccatcaacaaccgctatgtatttcgtacat

SEQ ID NO: 56770 - DNA, 498 bp, Homo sapiens
  misc_feature 2, 32, 40, 41: n = A,T,C or G
anaccgggacgtccccttcgtgaataccaagnacctgctnnttgttaagatggcccttgacattgagattgccacctacaggaagctgctggaaggcgaggagagcaggatttctctgcctcttccaaacttttcctccctgaacctgagggaaactaatctggattcactccctctggttgatacccactcaaaaaggacacttctgattaagacggttgaaactagagatggacaggttatcaacgaaacttctcagcatcacgatgaccttgaataaaaattgcacacactcagtgcagcaatatattaccagcaagaataaaaaagaaatccatatcttaaagaaacagctttcaagtgcctttctgcagtttttcaggagcgcaagatagatttggaataggaataagctctagttcttaacaaccgacactcctacaagatttagaaaaaagtttacaacataatctagtttacagaaaaatcttgtgctag

SEQ ID NO: 56771 - DNA, 480 bp, Homo sapiens
  misc_feature 477: n = A,T,C or G
tgacaccagtacgtgtgataaccctggtgaataatcgtggaaaaggtggagcgattagaatgggtatattcagttctcgaggagaaaagatccttatggcagatgctgatggagccacaaagtttccagatgttgagaaattagaaaaggggctaaatgatctacagccttggcctagtcaaatggctatagcatgtggatctcgagctcatttagaaaaagaatcaattgctcagcgttcttacttccgtactcttctcatgtatgggttccactttctggtgtggttcctttgtgtcaaaggaatcagggacacacagtgtgggttcaaattatttactcgagaagcagcttcacggacgttttcatctctacacgttgaacgatgggcatttgatgtagaacctactgtacatagcacagttctttaaaattccaatagcagaaattgctgtcaactggacagaaattgaaggntct

SEQ ID NO: 56772 - DNA, 303 bp, Homo sapiens
  misc_feature 29, 31: n = A,T,C or G
ggctccgaggttggaaagggaatgaattncnacgttgtatccgaaagaggaaaatggttggaagtagaatgttcgctgatgacctgcacaaccttaataaacgcatccgctatctctgcaaacactttaaccgacatgggaagtttcgatagaagagaaagctgagaacttcggaaaaggctcatctgtcaccctggagaagggaaactgtacttttccctgtgaggaaacggctttgtattttctctgtaataaaatggggcttctttggaatttgatagccacatacttttgttttcctca

SEQ ID NO: 56773 - DNA, 471 bp, Homo sapiens
  misc_feature 30: n = A,T,C or G
gttgggtggtttgtatattaattttaatgntgataaactacagtctaacaagagaaccctaacacagatcaaggagaaaaagaaaaatgagcttctgcagaaagccgtcattacacctgattttgaaaaaaaccactgtgttccaccatatagtgaatcaaagtatcaacttcaaaaaaaacgcagaaaagaacgacaaaaaacagcaggggatggctggtttggtatgaaagctccagaaatgacaaatgaactgaaaaatgatctcaaagcactgaagatgagagccagcatggacccgaaaagattttacaagaaaaatgatagagatggcttccccaagtacttccagattggaaccattgttgacaatccagctgatttctaccattcacgaattcccaagaagcaaaggaaaagaactattgtggaagaactgctggctgattctgaattcagaagatacaaccg

SEQ ID NO: 56774 - DNA, 316 bp, Homo sapiens
  misc_feature 25, 29, 41, 55, 68, 71, 94, 127, 176, 178, 182, 284, 290: n = A,T,C or G
gtattaatttattttcctccattcntgtncttttccttatntttccaaaactganactgagaatgggncangatcagtgagaaatctttacagntgacaggaacctggaccccttaccccaactttntgagtaatgcttggaataaaaactcttaaggcaactcactgatttactncnagcnatagcatgatgttacaggaatattacctctgtttaagcaaggtaatgtgtaaaatcagtctcggctgtcagaataacttctaaaaggttttttataagcagntcaagntactgaaaaccttttaaacctttctg

SEQ ID NO: 56775 - DNA, 478 bp, Homo sapiens
  misc_feature 10, 33: n = A,T,C or G
catcaccagnaacaaacactaatgttaattgcncaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagtatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcactt

SEQ ID NO: 56776 - DNA, 452 bp, Homo sapiens
  misc_feature 371, 419, 444: n = A,T,C or G
actatcacttgtggtttctgaactcattattgttgtatttccaaaaaagtaataccttttaattagtgtattaaaagttaagtataattattttaatgcaatctaatacaatcagattactcagttgccttacctcatgggaagagttacttttttagatctaaaaagctgaatagcatgttagttacttggtttcaacttgagttttcttttaatgttaataagattgaaactttagtatttagtggggaatggaaagagttgcccttgttgcaagtaatgaagcctgatttgattatgaagctgcttaatcactcttcatgtgttcagaattactgttttttttgtttgtttttcctttttgtcactgngtacattaaaattttggaagatgctttactatgtaaagtatagatggncattttaatcattcagccacatacnggtggctg

SEQ ID NO: 56777 - DNA, 490 bp, Homo sapiens
gagtccgagtggagagagcgagctgagtggttgtgtggtcgcgtctcggaaaccggtagcgcttgcagcatggctgaccaactgactgaagagcagattgcagaattcaaagaagctttttcactatttgacaaagatggtgatggaactataacaacaaaggaattgggaactgtaatgagatctcttgggcagaatcccacagaagcagagttacaggacatgattaatgaagtagatgctgatggtaatggcacaattgacttccctgaatttctgacaatgatggcaagaaaaatgaaagacacagacagtgaagaagaaattagagaagcattccgtgtgtttgataaggatggcaatggctatattagtgctgcagaacttcgccatgtgatgacaaaccttggagagaagttaacagatgaagaagttgatgaaatgatcagggaagcagatattgatggtgatggtcaagtaaactatgaag

SEQ ID NO: 56778 - DNA, 271 bp, Homo sapiens
  misc_feature 14, 43: n = A,T,C or G
gaaaagcagaaagnactaattaaaagtaagaactagtcaaagnattaaaccttgtaccttttgcataatgaactaactagaaaacttctaactaaaagaattacagctagaaaccccgaaaccaaacgagctacctaaaaacaattttatgaatcaactcgtctatgtggcaaaatagtgagaagatttttaggtagaggtgaaaagcctaacgagcttggtgatagctggttacccaaaaaatgaatttaagttcaattttaaacttgct

SEQ ID NO: 56779 - DNA, 467 bp, Homo sapiens
atctaaggtaatatatgcacctttcagaaatttgtgttcgagtaagtaaagcatattagaataattgtgggttgacagatttttaaaatagaatttagagtatttggggttttgtttgtttacaaataatcagactataatatttaaacatgcaaaataactgacaataatgttgcacttgtttactaaagatataagttgttccatgggtgtacacgtagacagacacacatacacccaaattattgcattaagaatcctggagcagaccatagctgaagttgttattttcagtcaggaagactacctgtcatgaaggtataaaataatttagaagtgaatgtttttctgtaccatctatgtgcaattatactctaaattccactacactacattaaagtaaatggacattccagaatatagatgtgattatagtcttaaactaattattattaaaccaatgattg

SEQ ID NO: 56780 - DNA, 149 bp, Homo sapiens
  misc_feature 26: n = A,T,C or G
tatggaccggggaagcggccaacagnaagacattataagatctgtgaagtggaaagagaagaaagagcagaagagtcaattgaggacatctatgctaatatccctgaccttccaaagtcctacataccttctaggttaaggaaggagat

SEQ ID NO: 56781 - DNA, 406 bp, Homo sapiens
ataggccgggggtttgaagatgccgcatttggattggatgaattccaaattctgcttgcttgctttttaatattgatatgcttatacacttacactttatgcacaaaatgtagggttataataatgttaacatggacatgatcttctttataattctactttgagtgctgtctccatgtttgatgtatctgagcaggttgctccacaggtagctctaggagggctggcgacttagaggtggggagcagagaattctcttatccaacatcaacatcttggtcagatttgaactcttcaatctcttgcactcaaagcttgttaagatagttaagcgtgcataagttaacttccaatttacatactctgcttagaatttgggggaaaatttagaaatataattgacagg

SEQ ID NO: 56782 - DNA, 391 bp, Homo sapiens
  misc_feature 18, 183: n = A,T,C or G
tcagttgtaccagtgaangacaagaaaacttctggaggtcaaactgggggagctgccaagctggatcttgatgcgggacttcagtcctagtggcattttcggagcgtttcaaagaggttactaccggtactacaacaagtacatcaatgtgaagaaggggagcatctcggggattaccatggngctggcatgctacgtgctctttagctactccttttcctacaagcatctcaagcacgagcggctccgcaaataccactgaagaggacacactctgcacccccccaccccacgaccttggcccgagcccctccgtgaggaacacaatctcaatcggtgctgaatcctttcatatcctaataggaattaacctccaaataaaacatgactg

SEQ ID NO: 56783 - DNA, 427 bp, Homo sapiens
gtaaattcaaaagcagaagaagcaactgttttctcatatgtaaagaaatcagtgtaataatgctgaagtatttaatagcaaagggttatggcatccccaaagaaacagtaattctccggtaatagatcctaaccaaaaagaaataatcaaaataccaatttaaattattgattgtaaagaatctcatggaaataaaaagacaaatctgaaaaccagtactgatgaatcaacaaattaattttgaatatgaatgacaagtgtaccaacgagatggatatcattatttctaaaaaagccagaactgctagaaaataaaaaattattgaaggaattaaacaagacagttgaaagcttcaacaagagactagagcaagcaaagcagagaatctcactgcttgaaacaaatcttttaaattaatagagtcat

SEQ ID NO: 56784 - DNA, 236 bp, Homo sapiens
  misc_feature 6, 24: n = A,T,C or G
agagcngacgctatctcagaaatntcagctaaacccagaaactagtcagttttaaggatcattttaaatattgtctgacttttgttatgaaaacaaatatttgtattgacagaacttagtacaataacaatcagtaaatgaatgttgaatcgattagaatgttataaacctctatgtaataggttttgtttgttagtatattcttctgattatttatttcttgaactataaccttc

SEQ ID NO: 56785 - DNA, 272 bp, Homo sapiens
  misc_feature 14: n = A,T,C or G
acccgggacttaanccagtggtggaagaacggtctcagtatctgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgg

SEQ ID NO: 56786 - DNA, 486 bp, Homo sapiens
  misc_feature 7, 31, 482: n = A,T,C or G
ggctgcnaagtaaccccactattgtatctgnttttatcttttgttcatctactttcacttacatacagtattatataagtagagaaaaatgggaaaatgcaagcaaattcaactttattttatacattgtatatatgtacaccctacactattcatttgggttttattaaagagatagtcacaaagggcttaccgaaaatcatttttgaattgataattagaatattgaataagcaatcctatgatccactaatttgttttatcagttaataatattaatcaaagacatttactgtatattctagtcattttgatttgagttaaccccaaatataaaattacctgtagtgatgtctctctcccagcccttatatgtggatattttttaagtggacttgtatgctgataattctagaccaaagtaaatatggcagaatatttatacatgaaaaaataattttgcaaatattttctataattgnattc

SEQ ID NO: 56787 - DNA, 227 bp, Homo sapiens
  misc_feature 12, 32, 132, 226: n = A,T,C or G
gtcaccaatagnactagtgaaacagggtaggntctagaaaccagctcatttttgtatgtaatcttgatttatgacagagcagtcactcatagttacagcagaagaaaaagggaccattacataaatagtggnggaacaactggttatccatagaagaaataaatgaagttggatacttactgtatatcatagttaaaatcagtcccttgaagattaaagtcttaant

SEQ ID NO: 56788 - DNA, 264 bp, Homo sapiens
  misc_feature 2, 18: n = A,T,C or G
gnaccgggctagatcagnaattgttgacttgcattcagaacataaatgcacaaaatctgtacatgtctcccatcagaaagattcattggcatgccacaggggattctcctccttcatcctgtaaaggtcaacaataaaaaccaaattatggggctgcttttgtcacactagcatagagaatgtgttgaaatttaactttgtaagcttgtatgtggttgttgatcttttttttccttacagacacccataataaaatatcatatt

SEQ ID NO: 56789 - DNA, 173 bp, Homo sapiens
  misc_feature 21: n = A,T,C or G
caaaacaaagtgttgcagagnatactttattctcagtatgtgtattaataacttgactcatctttctcatcaaaccttctccccaccagcacatacctggaggacatccagggtgcaatattgagggttcatctcccatgctctcctctttgtcacctcctctattcaattac

SEQ ID NO: 56790 - DNA, 488 bp, Homo sapiens
  misc_feature 30, 474: n = A,T,C or G
gaacactgatctggagaaggacattatttnggacacatctggtgacttccgcaagctgatggttgccctggcaaagggtagaagagcagaggatggctctgtcattgattatgaactgattgaccaagatgctcgggatctctatgacgctggagtgaagaggaaaggaactgatgtccccaagtggatcagcatcatgaccgagcggagcgtgccccacctccagaaagtatttgataggtacaagagttacagcccttatgacatgttggaaagcatcaggaaagaggttaaaggagacctggaaaatgctttcctgaacctggttcagtgcattcagaacaagcccctgtattttgctgatcggctgtatgactccatgaagggcaaggggacgcgagataaggtcctgatcagaatcatggtctcccgcagtgaagtggacatgttgaaaattaggtctgaattcaaganaaagtacggcaagt

SEQ ID NO: 56791 - DNA, 486 bp, Homo sapiens
  misc_feature 15, 30, 54, 80: n = A,T,C or G
gcccctgcgttttcntatggaccgggggtnccccggaagtgatcccctgcgtgnttgggctgctcgggttagatcgtcangaaaagcctaaagattagactgtaagaaaagaaaatagaagccatgtttcgaagacctgtattacaggtacttcgtcagtttgtaagacatgagtccgaaacaactaccagcttggttcttgaaagatccctgaatcgtgtgcacttacttgggcgagtgggtcaggaccctgtcttgagacaggtggaaggaaaaaatccagtcacaatattttctctagcaactaatgagatgtggcgatcaggggatagtgaagtttaccaactgggtgatgtcagtcaaaagacaacatggcacagaatatcagtattccggccaggcctcagagacgtggcatatcaatatgtgaaaaaggggtctcgaatttatttggaagggaaaatagactatggtgaatacatggat

SEQ ID NO: 56792 - DNA, 359 bp, Homo sapiens
  misc_feature 24: n = A,T,C or G
cgcgatccaagtgcccggcaggtnttggtccagggaaaagttggtctctgcagatgactgtaaatgactacctggaggtcgattaaagtgcggtactgcgggattcagccgatttccttcttcctctgactgcccggaaatatcagccaaaggccagcgttctaaggacatatggaattggctatggataattcatatgctttcaatcaacgaagcacatgtaatggaattccatctgagaagaaaaacaacttccttgtatcagaagatcatggacaaaaaatcttaagtgtactacagaattttagagaacaaaatgtcttttatgatttcaaaataattatgaaagatgaaataat

SEQ ID NO: 56793 - DNA, 440 bp, Homo sapiens
  misc_feature 29, 31, 56, 332: n = A,T,C or G
gaactccaggggtacctgagcgaattggntncaaagcagcagctgtattgccgcanttctagcttcaccttcacgatgtttcccttggtcaaaagcgcactaaatcgtctccaagttcgaagcattcagcaaacaatggcaaggcagagccaccagaaacgtacacctgattttcatgacaaatacggtaatgctgtattagctagtggagccactttctgtattgttacatggacatatgtagcaacacaagtcggaatagaatggaacctgtcccctgttggcagagttaccccaaaggaatggaggaatcagtaatcatcccagctggngtaataatgaattgtttaaaaaacagctcataattgatgccaaattaaagcactgtgtacccattaagatatggcattattgaagaaataaagtacatttgaaacctt

SEQ ID NO: 56794 - DNA, 500 bp, Homo sapiens
  misc_feature 7, 179, 440: n = A,T,C or G
taccagnacaaccttaaccaaaccctttacccaaataaagtataggcgatagaaattgaaacctggcgcaatagatatagtaccgcaagggaaagatgaaaaattataaccaagcataatatagcaaggactagcccctataccttctccataatgaattaactagaaataactttgcnaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttagatttgcccacagaaccctctaaatccccttgtaaatttaactgttagtccaaagaggatcagctctttggacactaggaaaaaaccttgtngagagagtaaaaaatttaacacccatagtaggcctaaaagcagccaccaattaagaaagc

SEQ ID NO: 56795 - DNA, 300 bp, Homo sapiens
  misc_feature 4, 29: n = A,T,C or G
gggntctcatggatcagaatctgttcttnacatattcctatgcacattggaatttgagatgtgtgcagtgctggagcaagtcagggaactctggcccatatccatctcttcttcatggcatatccctgtatacacactgggcacctccatctcccaccagggctcacacctttgaaaccctaaagcagtgtgtgtcaagagaggccccaccatgatgaattgcttttagatgttcctatagtttcctttaagaccaggaatcagcatttcctttgttagctaggtaaaaataatgaattg

SEQ ID NO: 56796 - DNA, 398 bp, Homo sapiens
  misc_feature 1, 65, 90, 93, 188, 201, 222, 247, 274, 299: n = A,T,C or G
natgggcgtttttctttattattacttttttttttctgcaggtcagtaaaaggatttaagttgcnctgacaaaaataccaaaataaaagngtntttttaagttcccatttgaaattgctggcgctgctggccggatgcatttttgagtttgtattagttgataaattaacagtaataacaagattgtntgaaccgcatggngcttgcagttttaaatattgnggatatttgtcctgcatcaaaaacnagctttggtttttacagattcaactgngttgaaatcaaacctgccgcaacanaaattgtttttatttcatgtaaaataagggatcaatttcaaaccctgcttatgatatgaaaatattaaaacctagtctattgtagttttattcaaactg

SEQ ID NO: 56797 - DNA, 146 bp, Homo sapiens
  misc_feature 146: n = A,T,C or G
gattgcacttttgttgaggaaagacagtgtaaatagttaaagaatgttgataaaattgaaacatttggttgtggaattgtgtgtggttttagagggtttctgtttgtgaaatgtatgtattaaaaataataaaattccagaaactn

SEQ ID NO: 56798 - DNA, 198 bp, Homo sapiens
  misc_feature 58: n = A,T,C or G
aaaggccatgatttgaatgtaattttgtgaatgtgtggaaaatataaagcagggattnagccttaataaaggtaaccttctgacatctgttgttaatccccctttgtactcttttcctgtatctgcactgttattttgagatgtcatactgtacactgtattgtaaaaataaaaagtaaaattatatttcaaattttc

SEQ ID NO: 56799 - DNA, 499 bp, Homo sapiens
  misc_feature 6, 42, 43, 45, 49: n = A,T,C or G
gagagnaccgggggtagccagcctctctccctactgctgctnntnaagnaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgggggaccaaatgagactgagggaagaaaaaaatctctttttttctggaggctggcacctgattttgtatccccctgtagcagcattactgaaatacataggcttatatacaatgcttctttc

SEQ ID NO: 56800 - DNA, 289 bp, Homo sapiens
  misc_feature 18, 21, 44, 156: n = A,T,C or G
tatggcccggggtgcagnggntacacgcctgtaatcccagtcantttgggaggtcaaggcaggcagatcacctgaggtcaggagttcgagaccagcctggccaacacgccaaaacgttgtctctactaaaaatacaaaaaattagctgggcatggnggtgggtgcctgtaatcccagctactcaggaggctgagccaggagaattgcctgaatccaggaggcagaggttgcagtgagccgagatcacaccattgcactccagcctgggcgaccgagtgagattctgtcc

SEQ ID NO: 56801 - DNA, 397 bp, Homo sapiens
aggaaagtgaagtatcagcagaaaatatcttaactgtagccaaggatccaagatatgccagatatctcaaaatggttcaagtgggtgtaccacgtgatggcaataagaaacaaaatgatatcagaaggactagacccagatcttcttgagaggccagatgctccagtgcctgatggcgaaagtgagaaaactgtagaagaaagttcagatagcgaatcttcttttagtgattaagcttaattttgataagaattacatatgcatgcataggggtacatttacattctgtaagagattgagcctgaactctcttagtcataaaaacatcaaatggccacatgtccactaccaagcttcttctatgttaaaaaaataataataaagcagttttaacctg

SEQ ID NO: 56802 - DNA, 470 bp, Homo sapiens
  misc_feature 29: n = A,T,C or G
gctcctttcgttgcctgatcgccgccatnttgggtcgcatgcatgctcccgggaagggcctgtcccagtcggctttaccctatcgacgcagcgtccccacttggttgaagttgacatctgacgacgtgaaggagcagatttacaaactggccaagaagggccttactccttcacagatcggtgtaatcctgagagattcacatggtgttgcacaagtacgttttgtgacaggcaataaaattttaagaattcttaagtctaagggacttgctcctgatcttcctgaagatctctaccatttaattaagaaagcagttgctgttcgaaagcatcttgagaggaacagaaaggataaggatgctaaattccgtctgattctaatagagagccggattcaccgtttggctcgatattataagaccaagcgagtcctccctcccaattggaaatatgaatcatctacagcctct

SEQ ID NO: 56803 - DNA, 486 bp, Homo sapiens
  misc_feature 5: n = A,T,C or G
gtagncggcttcgtcttcggtttttctctttcttcgctaacgcctcccggctctcgtcagcctcccgccggccgtctccttaacaccgaacaccatgccttcaattaagttgcagagttctgatggagagatatttgaagttgatgtggaaattgccaaacaatctgtgactattaagaccatgttggaagatttgggaatggatgatgaaggagatgatgacccagttcctctaccaaatgtgaatgcagcaatattaaaaaaggtcattcagtggtgcacccaccacaaggatgaccctcctcctcctgaagatgatgagaacaaagaaaagcgaacagatgatatccctgtttgggaccaagaattcctgaaagttgaccaaggaacactttttgaactcattctggctgcaaactacttagacatcaaaggtttgcttgatgttacatgcaagactgttgccaatatgatcaaggggaaaac

SEQ ID NO: 56804 - DNA, 465 bp, Homo sapiens
  misc_feature 6: n = A,T,C or G
ggtagnagcctctctccctactgctgctacacaagaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacatagg

SEQ ID NO: 56805 - DNA, 276 bp, Homo sapiens
  misc_feature 30: n = A,T,C or G
gacagctgtcaacctcagaataactatttntaaaaatgtaaatatgtattaatccttgtatcttttatggtaattttgcatattgatatgaattatataaaattgtttaaaataaaaggtgtccttgaattactgaccacccatagatgtctactgttaccaggttttacaatgcaaattttcactaatacctgggtttaatacagctcacatcactgaatgttacacatgagtttaaatgggtaatatacaggttttgttataataaagttactg

SEQ ID NO: 56806 - DNA, 487 bp, Homo sapiens
  misc_feature 30: n = A,T,C or G
atcaacagcagaggaaatattagattccgntatatcgttcttcaagacacttgctctaagcggaatggaaatgtgggcaagactgtctttgaatatagaacacagaatgtggcacgcttgcccatcatagatcttgctcctgtggatgttggtggcacagaccaggaattcggcgttggaattgggccagtttgttttgtgtaaagtaagccaagacacatcgacaatgagcaccaccatcaatgaccaccgccattcacaagaactttgactgtttgaagttgatcctgagactcttgaagtaatggctgatcctgcatcagcattgtatatatggtcttaagtgcctggcctccttatccttcagaatatttattttacttacaatcctcaagttttaattgattttaaatatttttcaatacaacagtttagggtttaagatgaccaatgacaatgaccacctttgcagaaagtaaactgattg

SEQ ID NO: 56807 - DNA, 199 bp, Homo sapiens
  misc_feature 25: n = A,T,C or G
atttaatcaaattatgctcttttancctttttaagaaaaagtacatttaatgatatgcacgtaaaaactttaggccaggcacggtggctcatgcctgtaatcccagcaccttgggagaccaaggcaaggtagattgcctgagcgcaggagttttgagaccatgagattacatggtgaagtcccatctctacaaaaattt

SEQ ID NO: 56808 - DNA, 113 bp, Homo sapiens
  misc_feature 113: n = A,T,C or G
ggaccgggtgctaccataagttgagtagggaagcacctgttgcattgtgagtagatattcataaactggaatgtgagccatgtgtaaaaaactttggtttcaactttaatggn

SEQ ID NO: 56809 - DNA, 490 bp, Homo sapiens
  misc_feature 31, 33: n = A,T,C or G
gctctctttccggctggaaccatggagggtntngaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggtaccccaatctgaagtcagtaaatgaactaatctacaagc

SEQ ID NO: 56810 - DNA, 470 bp, Homo sapiens
  misc_feature 7, 103, 109, 219, 274, 326: n = A,T,C or G
gaggccntgaggcagccagcgcaggggcttttgctgagggggcaggcggagcttgaggaaaccgcagataagtttttttctctttgaaagatagagattaatncaactncttaaaaaatatagtcaataggttactaagatattgcttagcgttaagtttttaacgtaattttaatagcttaagattttaagagaaaatatgaagacttagaagagtancatgaggaaggaaaagataaaaggtttctaaaacatgacggaggttgagatgaancttcttcatggagtaaaaaatgtatttaaaagaaaattgagagaaaggactncagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaagg

SEQ ID NO: 56811 - DNA, 500 bp, Homo sapiens
  misc_feature 41: n = A,T,C or G
tatggccggatttaacgaagacttcaaaatttttctcactnctcaagcttgggaactctcttctcacaagaagcaaggtcctggcttgctaagcaggatggggcaaaccgtcagagctgttgcgtcctcaatgagaggagttaaaaaccgcccagaggagttcatggaaatgaataactttattgaactatttagccagaaaataaatttgatagataaaatatctcagagaatttataaggaagaaagggaatattttgatgaaatgaaagaatatggcccaattcatattctgtggtcagcgtcagaagaggatctggttgatactctaaaggatgttgccagctgcattgacagatgctgtaaggccactgaaaagcggatgtctggactctcagaggccctgcttcctgttgtacatgagtacgtgctttatagtgaaatgttaatgggtgttatgaaaagaagagaccaaatacaagcagaactggattccaaag

SEQ ID NO: 56812 - DNA, 345 bp, Homo sapiens
  misc_feature 14, 30: n = A,T,C or G
gatggcatcttttnattaatgtatctgtanaagtttctttgtaaatactatgtgttctggtgtgtcttaaaattccaaacaaaatgatccctgcatttcctgaagatgtttaaacgtgagagtctggtaggcaaagcagtctgagaaagaaataggaaatgcagaaataggttttgtctggttgcatataatctttgctctttttaagctctgtgagctctgaaatatatttttgggttacttcagtgtgtttgacaagacagcttgatatttctatcaaacaaatgactttcatattgcaacaatctttgtaagaaccactcaaataaaagtctcttaaaaagg

SEQ ID NO: 56813 - DNA, 338 bp, Homo sapiens
  misc_feature 6, 31: n = A,T,C or G
tacctngtattttctaaggaagagctaaggnagttgctgcagaagctcagagagtcctctctaatgctcctagaccagggacttgacccattagggtatgaaattcagttatagtttaatctttgtaatctcactaattttcatgataaatgaagtttttaataaaatatacttgttattagtaattttttcttttgcattaccatgtaaaatttagacatttgaattttgtacttttcagaatattatcgtgacactttcaacatgtagggatatcagcgtttctctgtgtgcttgttaataaaactatataaaaattaaaattttctgtttttaca

SEQ ID NO: 56814 - DNA, 237 bp, Homo sapiens
  misc_feature 188, 221: n = A,T,C or G
ggactcccaagaagtactgtgtcttcctgttttgcatcgccatgatgtgtaacgaattctttgaaggcttcccagataagcagcccaggaagaaatgaaaactcctctgatgtggttggggggtctgccagctggggccctccctgtcgccagtgggcacttttttttttccaccctggctccttcanacacgtgcttgatgctgagcaagttcaataaanattcttggaagttttg

SEQ ID NO: 56815 - DNA, 500 bp, Homo sapiens
  misc_feature 4, 17, 43: n = A,T,C or G
gagnggccggggatgcnccgtgaagaagaaatgactgcaaaanttagggacctgcagactcaacttgaggagctgcggaagaaataccagcaaaagctagagcaggaggagaaccctggcaatgataatgtaacaattatggagctacagacacagctagcacagaagacgactttaatcagtgattcgaaattgaaagagcaagagttcagagaacagattcacaatttagaagaccgtttgaagaaatatgaaaagaatgtatatgcaacaactgtggggacaccttacaaaggtggcaatttgtaccatacggatgtctcactctttggagaacctaccgaatttgagtatttgcgaaaagtgctttttgagtatatgatgggtcgtgagactaagaccatggcaaaagttataaccaccgtactgaagttccctgatgatcagactcagaaaattttggaaagagaagatgctcggctgatgtcatggctccgatc

SEQ ID NO: 56816 - DNA, 489 bp, Homo sapiens
  misc_feature 4, 12, 38, 58: n = A,T,C or G
aacncgcggttntttatggcccgggcatatacaaaagnaataagaaaattcttaaatntgcaaaagatttgcctcctgatgcacttatcattgaatacagagggaagtttatgctgagagaacagtttgaagcaaatgggtatttctttaaaagaccatacccttttgtgttattctactctaaatttcatgggctagaaatgtgtgttgatgcaaggacttttgggaatgaggctcgattcatcaggcggtcttgtacacccaatgcagaggtgaggcatgaaattcaagatggaaccgtacatctttatatttattctatacacagtattccaaagggaactgaaattactattgcctttgattttgactatggaaattgtaagtacaaggtggactgtgcatgcctcaaagaaaacccagagtgccctgttctaaaacgtagttctgaatccatggaaaatatcaatagtggttatgagaccagac

SEQ ID NO: 56817 - DNA, 225 bp, Homo sapiens
  misc_feature 31, 32, 33: n = A,T,C or G
gatcaaaagggacaagcatcaagcacgcagnnntgcagctcaaaacgcttagcctagccacacccccacgggaaacagcagtgattaacctttagcaataaacgaaagtttaactaagctatactaaccccagggttggtcaatttcgtgccagccaccgcggtcacacgattaacccaagtcaatagaagccggcgtaaagagtgttttagatcaccccctccc

SEQ ID NO: 56818 - DNA, 194 bp, Homo sapiens
  misc_feature 44, 53, 113: n = A,T,C or G
tatggaccggggggcttctcttttttatttcatcactagttatntcaaagaanactcggagccagtgatccttttatcctgctacagtctttagggagctaaaaaaaaaagcnggggctgccaaaactcttgatttcatatttccttctctaaatatatatgtatcctgttttttggataaaattttaccaaga

SEQ ID NO: 56819 - DNA, 490 bp, Homo sapiens
  misc_feature 6: n = A,T,C or G
ggaagntttagaggaaagggaagtggaggcttaaaccttggtaatttctttgcaagccgtaagggctacagtcgaaaagggtttgaccggcttagcactgagggcagtgaccaagagaaagaggatgatggaagtgaatcagaagaggagtattcagcacctctgcctgcgctcgcaccttcctcctcctgaaaaccaagctttgatttagattgagtaagatttacccagaatgtcagattcctttccctttagcacgtttaaagttctgtgtatttaatttaaaactgtactagtctgtgtgggactgtacacactttatttacttcgttttggttaagttggcttctgtttctagttgaggagtttcctaaaagttcataacagtgccattgtctttatatgaacatagactagagaaaccgtcctctttttccatcataattctaatctaacaatggaagatttgcccatttacacttttgagact

SEQ ID NO: 56820 - DNA, 469 bp, Homo sapiens
  misc_feature 17, 43: n = A,T,C or G
tatggaccgggatggancgaggagactggcaacctgaaaaagnctgtcattctacagggctctaatgatgttgaacttgttgctgagggcaacagcaggttcacttacactgttcttgtagatggctgctctaaaaagacaaatgaatggggaaagacaatcattgaatacaaaacaaataagccatcacgcctgcccttccttgatattgcacctttggacatcggtggtgctgaccaggaattctttgtggacattggcccagtctgtttcaaataaatgaactcaatctaaattaaaaaagaaagaaatttgaaaaaactttctctttgccatttcttctccttcttttttaactgaaagctgaatccttccatttcttctgcacatctacttgcttaaattgtgggcaaaagagaaaaagaaggattgatcagagcattgtgcaatacagtttcattaactcctt

SEQ ID NO: 56821 - DNA, 479 bp, Homo sapiens
  misc_feature 2: n = A,T,C or G
gngacaatgatgaacggttcatttttcctttttctctccttgtacctgccagattatttaagaatttcagctgccaaattatacgaatgccatttatttacgtgactggtgttggtctgttgattaatgtctaatgtttttctaatttcagactttaatttaccgaaaattcctaatgaaaaaggctcttaagccagaaaccaattgcctcttatcggttatccccaactgtagatcttctatgagaaagtggggaagtgaatgtaaaattttattcactacaaactgagttctttgttcctttattaagtcaaaatttctccaggaaaatttcatatttttatgaaacagcaagttttatgttctttattgttaaactctcacaactgataaaattatcccgaaatgacataaccaaaatgcttctcctctcattagtctaccatgactatgatatcttatgtaaatatgtgactaac

SEQ ID NO: 56822 - DNA, 166 bp, Homo sapiens
gcagggagataattctgccttaaattgtctaaaacaaaaacaaaaccagccaacctatgttacacgtgagattaaaaccaatttttttcccattttttctccttttttctcttgctgcccacattgtgcctttattttatgagccccagttttctgggcttagttt

SEQ ID NO: 56823 - DNA, 230 bp, Homo sapiens
  misc_feature 15, 24, 29, 32, 45, 69: n = A,T,C or G
aaccgggaaaaaccncagttaagnaaggnagnaaacttctttttntactgtatgaacaaggtgatatcntcatagtgggctattacaggcaggaaaatgttttaactggtttacaaaatccatcaatacttgtgtcattccctgtaaaaggcaggagacatgtgattatgatcaggaaactgcacaaaattattgttttcagcccccgtgttattgtccttttgaactgt

SEQ ID NO: 56824 - DNA, 480 bp, Homo sapiens
  misc_feature 31: n = A,T,C or G
gcactctgtagtgtttaaagaaacaaagaanctctaatattgaatctcttaaatttagtgtatgtaaacagcttacaaatacgtattgtctaaatgcatttaaatctgttttattcaaagaaaagctaaagcaaaaacactggcatatgaccatgcaagactgtcagtgccaacaaagacaacactaatcagcacatcgtacactggattgcagtgcttcccagattattgaaaaatgttacagacaacttgcctgatttttaaatgagcgtaaaaggccctctaacctatgcaggtttccccattatgcatatagaaaatgctagtatgttttgctcacttcatatgtaacaggtgcccttatgttgtgctgtatcctgtgctttttctgtgggaccattccattcaggagcaaagagcaccatgattccaatcttgtgtgtgtttactaacccttccctgaggtttgtgtatgttgga

SEQ ID NO: 56825 - DNA, 465 bp, Homo sapiens
  misc_feature 1: n = A,T,C or G
nagttcagctacggcaatcctgaacttccttaagatgtccttgatgtgcagcgggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcaccgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtc

SEQ ID NO: 56826 - DNA, 282 bp, Homo sapiens
  misc_feature 3, 17: n = A,T,C or G
tanggaccgggtaaatnaaataaaataaccccgggcaagacttttctttgaaggatgactacagacattaaataatcgaagtaattttgggtggggagaagaggcagattcaattttctttaaccagtctgaagtttcatttatgatacaaaagaagatgaaaatggaagtggcaatataaggggatgaggaaggcatgcctggacaaacccttcttttaagatgtgtcttcaatttgtataaaatggtgttttcatgtaaataaatacattcttggaggag

SEQ ID NO: 56827 - DNA, 273 bp, Homo sapiens
  misc_feature 16, 24, 40: n = A,T,C or G
aggaccgggaaattgnaatttttntgatgctactaatttnccactaaatactgcaaatggtcaccctgaatctcttctgacattggatgttatttgcttatattcttataattttaaatgagggcacagtgaaatgaaaattttatactctatgtttctgtttatttttaaatccttaacagcaaaatatttgcctttaatttcttttttatatatactctcagagaattcctcttaatttttaaagatgctggtgataataaaattcattag

SEQ ID NO: 56828 - DNA, 193 bp, Homo sapiens
  misc_feature 3: n = A,T,C or G
tanggaccgggaattgcctatttttaaagaatttcattcaactcagaagtcttaggcttaaaatcctagagtgatctctgaatctggtggagtaaattcaatccagttggtcaagtagtcctgctgctgctttcattcatctattggtaaatgccacatttgtgtggagctctgttctaggtttaggagatta

SEQ ID NO: 56829 - DNA, 499 bp, Homo sapiens
  misc_feature 2: n = A,T,C or G
tnggaagacatcaaagtcaaggaagaaagtaagagctcacggcttggggtggaaatggttactaagtttagccatctgctttggtctttcctgttccacatgtagctatatagtttacataaaagtatctctccagaggatcaggaaagaacagatttatggaaccagatgtgagttagcatttctacaggtgtggctctgcagctgaaagaacatgttgtaccagggatgaagtttcttattttgtaatcaatataaattaccactagacttttacagaggttgataaagcaaacacgtgtcattcggattggccttctggtatataaagagaccctgcttcacaacgtgaaaaaatgtaccgtttgacattcataaaagacttggtagaaaataccatgacaataatcaggcaaggttgttcccccttgcacacagaggggatagctggtggctagatggaaattgtgttcatatgtttttcttcatcaagaaaaac

SEQ ID NO: 56830 - DNA, 234 bp, Homo sapiens
  misc_feature 4, 6, 27, 54, 79, 81, 100, 123, 133, 143, 163, 199, 217, 220: n = A,T,C or G
gagncntgaggcagccagcgcaggggnttttgctgagggggcaggcggagcttnaggaaaccgcagataagtttttttntntttgaaagatagagattantccacctccttaaaaaatatagncaataggttnctaagatatngcttagcgttaagtttttancgtaattttaatagcttaagattttaagagaaaatntgaagccttagaagagtnccntgaggaaggaaaag

SEQ ID NO: 56831 - DNA, 164 bp, Homo sapiens
  misc_feature 25: n = A,T,C or G
gagataggcgtaaaattgatgatcnacgtggaaatcttagtgggaacagtcataagcataaaggtgaggctaaagaacaagagaggaaaaaggagaggagtccgaagtatagataaagataggaaaaagaaagacaaagaaagggaacgtgaacaagataaaag

SEQ ID NO: 56832 - DNA, 278 bp, Homo sapiens
  misc_feature 3, 11, 28, 29, 48, 199: n = A,T,C or G
acnctttcgancccaggggacccgcgtnntttatggaccgggacagtnctcactttttccaaatgatcctagtaattgcctagaaatatctttctcttacctgttatttatcaatttttcccagtatttttatacggaaaaaattgtattgaaaacacttagtatgcagttgataagaggaatttggtataattatggngggtgattattttttatactgtatgtgccaaagctttactactgtggaaagacaactgttttaataaaagatttacatt

SEQ ID NO: 56833 - DNA, 488 bp, Homo sapiens
  misc_feature 3, 31, 451: n = A,T,C or G
ggnagcggtttctgggagccaagaagtggtnttggcgtctgtatgatcttcggagcctgctgcatcggacctcggccagtcataaaagatgacaacagcagccaggccaacctttgaacctgccagaggtggaaggggaaaaggagaaggtgatttgagccaactttcaaagcagtattcaagcagagacctaccctctcatacaaagataaaatacagacagactactcaggatgcccctgaagaggttcgtaaccgtgacttcaggagagagttggaagaaagagagagagctgctgcaagagagaaaaatagggatcgtccaacccgagaacatacaacctcctcttcagtgtcaaaaaagccacggttagaccagattcctgccgccaaccttgatgcagatgaccctctaacagatgaggaagatgaagattttgaagaagaaagngatgatgatgatactgcagctcttcttgcagaactgg

SEQ ID NO: 56834 - DNA, 376 bp, Homo sapiens
  misc_feature 71, 194, 336, 366, 369: n = A,T,C or G
tagcctgaggaagaagggaggtctccatttctatgtctggtatttgggggttttgtttgtttttgctttancttggggaaaaaaagttcactgaacaccaagaccagaatggatttttttaaaaaaatagatgttccttttgtgaagcaccttgattccttgattttgattttttgcaaagttagacaatggcncaaagtcaaaatgaaatcaatgtttagttcacaagtagatgtaatttactaaagaatgatacacccatatgctatatacagcttaactcacagaactgtaaaagaaaattataaaataattcaacatgtccatctttttagngataataaaagaaagcatgggattaaactntcntagaagt

SEQ ID NO: 56835 - DNA, 321 bp, Homo sapiens
  misc_feature 4, 28, 208, 313: n = A,T,C or G
tggntcttggtttcatttttggtggccngggagatctgtaaataaaattgccggatttaaagcttaagctttcaggaaaaagaaaataagaattcagtgtgtgcctgacaactcgtgtgtatgagaaggagggatatgaaggaagatggcttgcagagtaagtcgggtggcaattgtcagggggtgggaatttcttttcctacggggnacgtgattttgtaaaaaggaagtatttctcccaaaattgggagtaggcaaactactaatcagtttagctttgtgttgtatgctagtttaaaaaagaaaatatgtnatataatg

SEQ ID NO: 56836 - DNA, 287 bp, Homo sapiens
  misc_feature 173, 182, 188, 247: n = A,T,C or G
ggtgaaggggaatgtgttcaaaaacaagccggattctcatggaacacatccacaagctgaaggcagacaaggcccgcaagaagctcctggctgaccaggctgaggcccgcaggtctaagaccaaggaagcacgcaagcgccgtgaagagcgcctccaggccaagaaggagganatcatcaanactttntccaaggaggaagagaccaagaaataacccctcccactttgtctgtacatactggcctntgtgattacatagatcagccattaaaataaaacaagcctt

SEQ ID NO: 56837 - DNA, 440 bp, Homo sapiens
  misc_feature 2: n = A,T,C or G
cnactggccgggcaatctagttaaatttcccatttgtattttattttcttgaatacttttttcatagttatttgtttaaaaagatttaaaaatcattgcactttggtcagaaaaataataaatatatcttataaatgtttgattcccttccttgctatttttattcagtagatttttgtttggcatcatgttgaagcaccgaaagataaatgatttttaaaaggctatagagtccaaaggaatattcttttacaccaattcttcctttaaaaatctctgaggaatttgttttcgccttacttttttttcttctgtcacaatgctaagtggtatccgaggttcttaatatgagatttaaaatcttaaaatgtttcttatttttcagcacttacatcatttggtacacagggtcaaatagggcaaataattttgtctttgat

SEQ ID NO: 56838 - DNA, 490 bp, Homo sapiens
  misc_feature 463: n = A,T,C or G
tatggccggggaccctttgtgtttactaatagataaagccagatataattttttgtttttaaggccacaaaatatggcctttgttaaagaacactaaagttagaaatctaaagttagagcaactttttaatggctatttcctattattgtaagtgttaaaacccctgcagaattcttgataaggtgctatttatactatatttcttattataagataactgtctttagtcttcttagtactagtctttttagtactaaatcaatcagcaaacatcatcatttcaccccaaaattttgtcacagaaaaggcgtatcaaatgaaaaataatttcagagatctttctttcaagatattttttcctgataaaatacattgtcttgaagtaaatacattgtcaaaacctaattgcaattctgttaaatctaagtaatttttagacagtgtttcaccgtattatttaanggatggtgaaatgccatttctttcact

SEQ ID NO: 56839 - DNA, 313 bp, Homo sapiens
gaccaggggagtgggaaaaagattgagcaggattctcttaggctatgagagagtcaggcagcccccaagataaaataatgaactagaaaatctggaaccttacttctctgggaatcttacctatctggcacgtgggaaggaagaaaaaaggctactgagtaccctgaaatgtcacgaagttgatgcaatgaaactcacacatctcactctgagccagttgactataactttcccagcccttgatatattggaagattagaggggaattgccagaagtaaaccaactgtctgctgaaagaaaaagaagatatcg

SEQ ID NO: 56840 - DNA, 499 bp, Homo sapiens
  misc_feature 2, 59: n = A,T,C or G
cnaggaccggggttttttaaaatgtgagaacttctgcactacaaaattcccttcacagnagaagtataatgtagttccaacccgtgctaactaccttttataaattcagtctagaaggtagtaatttctaatatttagatgtcttagtagagcgtattatcatttaaagtgtattgttagccttaagaaagcagctgatagaagaactgaagtttcttactcacgtggtttaaaatggagttcaaaagattgccattgagttctgattgcagggactaacaatgttaatctgataaggacagcaaaatcatcagaatcagtgtttgtgattgtgtttgaatatgtggtaacatatgaaggatatgacatgaagctttgtatctcctttggccttaagcaagacctgtgtgctgtaagtgccatttctcagtattttcaaggctctaacccgccttcatccaatgtgtggcctacaataactagcatttgttgatttgtc

SEQ ID NO: 56841 - DNA, 336 bp, Homo sapiens
  misc_feature 4, 258: n = A,T,C or G
aggntttaggaagaactcatacaactcaatagcaagacaacatataacctgattaaaaaaaagtggggaaaggacttgaatagacatttcttcaaagatgacagaaaatgaccaacaggtatatgaagtggtgctcaatatcaccaatcatcgggaaaatgcgaatcaagactactttgagataccacctcatacatgttaggatggctattatcaaaaagacaagagctaacaagtgttggtgagggtgtggagaanagggagcacttgtacactgctagtgggaatgtattatatattggtgcagccattatggaggacagtatggaggttcct

SEQ ID NO: 56842 - DNA, 354 bp, Homo sapiens
actcttggcatgtaagaaataagcatttacataattggaaaaatctggatttctgatgccaaagggttaaagcttcttggatttcatttcattgatatacagccactattttatttttgatcagtggcctttgggccactgttcagggtactgaccatcagtgtcagcattagggttttggtttttgtttcttttgggtctttcttttttggcacatgtgaatcttgttttgtgtaaaatgaaattactttctcttgttctctgatgatgggtttaaaattaaaagagcatccggttttggtatggggatgatccaggattatgttgtgactgatacatattagttacttgtgc

SEQ ID NO: 56843 - DNA, 195 bp, Homo sapiens
  misc_feature 13, 16, 33: n = A,T,C or G
ggggggtggcaanaanaggccgggagagaaganggagtgtatgtagaagggctgttaaaaatgtaaaacttggttgcattatttgtggaggctcaaacttgtgaaggttaataccataatttttccatttgttctgcattttgattctgaaaagaaagctggctttgcccatttcttattaaaaaaacttgttgc

SEQ ID NO: 56844 - DNA, 209 bp, Homo sapiens
  misc_feature 3, 5: n = A,T,C or G
aananaggccggggtgggcacaactgtgtgctctgctttccagcatcctggttgggttaaaagtggcttgggcagtggacccaaatgctgccattaaagaattataggggtttaaaaactctcattcattttaaatgacttacctttatttccagttacattttttttctaaatataataaaaacttacctggcatcagcctcatacct

SEQ ID NO: 56845 - DNA, 478 bp, Homo sapiens
  misc_feature 7, 8, 452: n = A,T,C or G
gtcttanncgccatcttggctcctgtggaggcctgctgggaacgggacttctaaaaggaactatgtctggaaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaacaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtgatgctgtacccctcaaggatttaaactaacgaaaaatcaataaataaatgtgggattttgtgctcttgtattttttaaggngggatttaaaaaaacttactaccctt

SEQ ID NO: 56846 - DNA, 489 bp, Homo sapiens
  misc_feature 6, 7: n = A,T,C or G
aagagnntaactgaagttttctatgatgctgcgagaaaagagtttgagtgccctcaatgaaggagaaggctcttgcttttgaacagctattgaaagagaaagaacagggcaagactggagagttaaatcagcttttaaatgcagttaaatcaatgcaggagaagacagttgtgtttcaacaggagagagaccaagtcatgttggccctgaaacaaaaacaaatggaaaatactgccctacagaatgaggttcaacgtttacgtgacaaagaatttcgttcaaaccaagagctagagagattgcgtaatcatcttttagaatcagaagattcttatacccgtgaagctttggctgcagaagatagagaggctaaactaagaaagaaagtcacagtattggagggaaaagctagtttcatcctctaatgcaatggaaaatgcaagccatcaagccagtgtgcaggtagagtcattgcaagaacagttgaat

SEQ ID NO: 56847 - DNA, 232 bp, Homo sapiens
  misc_feature 4, 9, 33: n = A,T,C or G
ccgnccccntctggccgggagaaaaaactaagnactgaaatatacaaggtttcttttgtgatataacaaagtagaattgaaagtatgtggaaaggacataaggtcttacctaagaaaaattttcaattatgtttagtacggttttattaaaattgaggatcatttaaaatacactgataatattaggtgtcctattgagaggtcttttctattgtatgtatttcattcattt

SEQ ID NO: 56848 - DNA, 457 bp, Homo sapiens
ggaggtgaaaaagctggcggttttgccccgtattatggagatgaaccaatggatttcaaaatcaacaccgatgagattatgacttcactcaagtctgttaatggacaaatagaaagcctcattagtcctgatggttctcgtaaaaaccccgctagaaactgcagagacctgaaattctgccatcctgaactcaagagtggagaatactgggttgaccctaaccaaggatgcaaattggatgctatcaaggtattctgtaatatggaaactggggaaacatgcataagtgccaatcctttgaatgttccacggaaacactggtggacagattctagtgctgagaagaaacacgtttggtttggagagtccatggatggtggttttcagtttagctacggcaatcctgaacttcctgaagatgtccttgatgtgcagctggcattccttcgacttctct

SEQ ID NO: 56849 - DNA, 304 bp, Homo sapiens
  misc_feature 3, 6: n = A,T,C or G
aanacnggaccggggaggcattgaggcagcccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaacatgaagacttagaagagtagcatgaggaaggaaaagataaaaggtttctaaaacatgacggaggttgagatgaagcttcttcatggagta

SEQ ID NO: 56850 - DNA, 258 bp, Homo sapiens
acgggggttgaatatcagtcaattgcctacacttctaaacaataagtgccaatgtctcaattttctcaccctgaatgatagaagctagctttatcaaatgccaaggttagaaagcctggaaataaaacttaagcacagacattcaagtttttgaaaagcataagcctaaattcagataaatcacactgatatattgtactatgcatagaaagttgtaggtggcgttcagggaagactttgattttaataaagcaatat

SEQ ID NO: 56851 - DNA, 356 bp, Homo sapiens
aaataatgatggggctaagttatacccaaagctcactttacaaaatatttcctcagtactttgcagaaaacaccaaacaaaaatgccattttaaaaaaggtgtattttttcttttagaatgtaagctcctcaagagcagggacaatgttttctgtatgttctattgtgcctagtacactgtaaatgctcaataaatattgatgatgggaggcagtgagtcttgatgataagggtgagaaactgaaatcccaaacactgttttgttgcttgttttattatgacctcagattaaattgggaaatattggcccttttgaataattgtcccaaatattacattcaaataaaagtgcaatg

SEQ ID NO: 56852 - DNA, 348 bp, Homo sapiens
  misc_feature 3, 17, 27, 28, 29, 37, 54: n = A,T,C or G
ccntttccggcggtgancgacctagcnnncgagaaantgccctctcgcaagganctcctttcatcccctctccagaagaggagaagagggaacacaagaagaaacgcctggtgcagagccccaattcctacttcatggatgtgaaatgcccaggatgctataaaatcaccacggtctttagccatgcacaaacggtagttttgtggtgttggctgctccactgtcctctgccagcctacaggaggaaaagcaaggcttacagaaggatgttccttcaggaggaagcagcactaaaagcactctgagtcaagatgagtgggaaaccatctcaataaacacattttgggt

SEQ ID NO: 56853 - DNA, 425 bp, Homo sapiens
  misc_feature 7, 14, 28: n = A,T,C or G
aggagtncgttggnggacagcccgcagnacaaggtctttactaggtgtatttgaagaagatgccacagctatttccaactatatgaaccagttgtatcaagctatgcatcggatttatgatgcacagaatgaattaagtgcagcaacacacctgacctcaaaacttttaaaagaatatgaaaaacagcgttttccattgggaggtgatgatgaagttatgagctctacattgcaacagttttcaaaagttatagatgagcttagctcttgtcatgcagtgctttcaactcaacttgctgatgccatgatgttccccattacccagtttaaagaaagagatctgaaagaaatactaacattaaaggaagtatttcagattgcaagtaatgatcatgatgctgcgattaatagatatagccgttttt

SEQ ID NO: 56854 - DNA, 380 bp, Homo sapiens
  misc_feature 4, 33, 44, 61: n = A,T,C or G
accnggcccggggtcctgtgggtgggaccaganaccagtctccntggcctataatgaaacnctaggactttatacagttttccttaatttgttgacatataaatggtaaattatatttaggcttatcctgttttgaaatgatggtagtcatctttcttactgctactttcatgttgctttctagaaaacagcatttcattccaaaataactaggatctgcatttagaacaagaatcattatttgtcctgaccttttcagtcctacagagacgcatctgtggttcttttgtacttgccatagatgtaacctaaaaagttttggcatatttaggtcagcctagcggaactttttttttcatttaaatgggagctgaataatg

SEQ ID NO: 56855 - DNA, 164 bp, Homo sapiens
  misc_feature 32, 49: n = A,T,C or G
gccggcggcaggcgccatgtccggccgcgaangtggcaagaagaagccnctgaaacagcccaagaagcaggccaaggagatggacgaggaagataaggctttcaagcagaaacaaaaagaggagcagaagaaactcgaggagctaaaagcgaaggccgcggggg

SEQ ID NO: 56856 - DNA, 439 bp, Homo sapiens
  misc_feature 13, 29, 404: n = A,T,C or G
tcctgaagctgangcattcgggccgagangtctcgctccgtggccttagctgtgctcgcgctactctctctttctggcctggaggctatccagcgtactccaaagattcaggtttactcacgtcatccagcagagaatggaaagtcaaatttcctgaattgctatgtgtcttgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaaagtgggatcgagacatgtaagcagcatcttgggangttttggaagatgccgcatttggatttgggattga

SEQ ID NO: 56857 - DNA, 298 bp, Homo sapiens
  misc_feature 2, 11, 52: n = A,T,C or G
anggcggccanaaaaggaccgggggacagcacggttcgtttttcctttagtnggaaggacgttggtgttgaggttagcatacgtatcaaggacagtaactaccatggctcccgaagttttgccaaaacctcggatgcgtggccttctggccaggcgtctgcgaaatcatatggctgtagcattcgtgctatccctgggggttgcagctttgtataagttttcgtgtggctgatcaaagaaagaaggcatacgcagatttctacagaaactacgatgtcatgaaagattttgagggaga

SEQ ID NO: 56858 - DNA, 291 bp, Homo sapiens
  misc_feature 7, 64, 125, 151, 161, 209, 213, 223, 288: n = A,T,C or G
atggacncgggatagataaaagtaataaagatggtaacatagggtcaagattttaagtcaagcntcccaacttttatctgtttcactcactcttaacctcctcactcttgtatatgacatgattntaaaaaaaatatttatctcacatcgnccaggcgagnccgcccaatgacatggggctttcttgactcaaattcaagaaaaatctntgtnggaggccaanacaggaggattacttgagcccaggagtttaagaccagcctgggcaacatagcaagaccctgtctntac

SEQ ID NO: 56859 - DNA, 337 bp, Homo sapiens
  misc_feature 17: n = A,T,C or G
acacggggctttttgtnccgacatcttgacgaggctgcggtgtctgctgctattctccgagcttcgcaatgccgcctaaggacgacaagaagaagaaggacgctggaaagtcggccaagaaagacaaagacccagtgaacaaatccgggggcaaggccaaaaagaagaagtggtccaaaggcaaagttcgggacaagctcaataacttagtcttgtttgacaaagctacctatgataaactctgtaaggaagttcccaactataaacttataaccccagctgtggtctctgagagactgaagattcgaggctccctggccagggcagcccttcagga

SEQ ID NO: 56860 - DNA, 377 bp, Homo sapiens
  misc_feature 358: n = A,T,C or G
tatggccggggataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatggaaagattaattggggagtggtanggatgaaacaatttgggag

SEQ ID NO: 56861 - DNA, 174 bp, Homo sapiens
  misc_feature 66, 135, 174: n = A,T,C or G
accgctcagtattttaaatgaagtgattctaagatttggtttgggatcaataggaaagcatatgcngcccaaccaagatgcaaatgttttgaaatgatatgacccaaaattttaagtaggaaagtcaccccaacnctttctgctttcaccttaagggtctgggcccccccaatn

SEQ ID NO: 56862 - DNA, 320 bp, Homo sapiens
  misc_feature 8: n = A,T,C or G
gtagcacnaatcctattactcttcctctaacatttttgaggaagttttgtctaattatcaatattgaggatcagggctcctaggctcagtggtagctctggcttagacaccacctggagtgatcacctcttggggaccctgcctatcccacttcacaggtgaggcatggcaattctggaagctgattaaaacacacataaaccaaaaccaaacaacaggcccttgggtgaaaggtgctatataattgtgaagtattaagcctaccgtatttcagccatgataagaacagagtgcctgcattcccaggaaaatacgaaaat

SEQ ID NO: 56863 - DNA, 394 bp, Homo sapiens
gttttggaacatatgtttaagtacttgggaaagtctttctcttcatgtttactgatggtatttcagtttttagaaatcgtatcagattagttaaggtttatcagtagtctttagctttgcctacatacttttcataattaattgaagtcatgctatccacagtatactttctttaaattttattgtcttttcttgaaaaaattttggaaatgttataagtagtcatctttaaaactatgtagccctcagcctggtgtggtggcacgtgcctgtggtccctgctacttgggaggctgagatgggggagattgcttgagcctgggaggtcgaggctgcagtgaaccatgattgtgccactgcccttcagcctgggtgaccctgagtgagaccctat

SEQ ID NO: 56864 - DNA, 399 bp, Homo sapiens
  misc_feature 367, 377: n = A,T,C or G
gatgctcaccctgatagaggattgagtaaacggctaggctagaggtggctagaataaataggaggcctaggttgaggttgaccagggggttgggtatggggaggggggttcatagtagaagagcgatggtgagagctaaggtcggggcggtgatgtagagggtgatggtagatgtggcgggttttaggggctctttggtgaagagttttatggcgtcagcgaagggttgtagtagcccgtaggggcctacaacgttggggcctttgcgtagttgtatatagcctagaatttttcgttcggtaagcattaggaatgccattgcgattagaatgggtacaatgaggagtaggaaggttggccatgggtntgttgttaanaagaggaattgaacctctgact

SEQ ID NO: 56865 - DNA, 184 bp, Homo sapiens
  misc_feature 184: n = A,T,C or G
tatggccgggggaatataattgagaatccggaatttaaaccatacatatatggctaattggtattcaacaaggatggcaaggcgattcagtgtggaagaatagtcttcaagaaatgatgatgggacaacccgatttccacatataaaagaatgaatttggactccttacctcacaccatgtgtn

SEQ ID NO: 56866 - DNA, 413 bp, Homo sapiens
  misc_feature 190: n = A,T,C or G
gatctatgttctctcagtagaaaaaaaaatacttataaaattacatattctgaaagaggattccgaaagatgggactggttgactcttcacatgatggaggtatgaggcctccgagatagctgagggaagttctttgcctgctgtcagaggagcagctatctgattggaaacctgccgacttagtgcggngataggaagctaaaagtgtcaagcgttgacagcttggaagcgtttatttatacatctctgtaaaaggatattttagaattgagttgtgtgaagatgtcaaaaaaagattttagaagtgcaatatttatagtgttatttgtttcaccttcaagcctttgccctgaggtgttacaatcttgtcttgcgttttctaaatcaatgcttaataaaatatttttaaagg

SEQ ID NO: 56867 - DNA, 251 bp, Homo sapiens
aatctgtaggctcattcatttctctaacagcagtaatattaataattttcatgatttgagaagccttcgcttcgaagcgaaaagtcctaatagtagaagaaccctccataaacctggagtgactatatggatgccccccaccctaccacacattcgaagaacccgtatacataaaatctagacaaaaaaggaaggaatcgaaccccccaaagctggtttcaagccaaccccatggcctccatgacttttcc

SEQ ID NO: 56868 - DNA, 200 bp, Homo sapiens
aaggttccttgcattctgcccattattgaaaatgggaagaaggttagttcaacacattattacctactacctgaacgaccaccatacctggacaaatatgaaaaattttttagggaagcagaagaaacaaatggaggcgcccaaatccagccattacctgctgactgcggtatatcttcagccacagaaaagccagactc

SEQ ID NO: 56869 - DNA, 297 bp, Homo sapiens
ggcagacccactggaagtcaggcacggaccagtggcccagccctgggtgtcccatcaccatgtgaccttggacatgtcccttcccctctctggccctcagtttccccactgggacattgtgtgctgcaaagccattggttgggctacttcttcataggcacttacttacccagggatgccaccctttcgtcacctcttccacagagcactttggcatgtaaacaagcaagagcactgcctctatagggtaacctggaacattctctaggttatatcaatataaaacaatgtaaatgg

SEQ ID NO: 56870 - DNA, 471 bp, Homo sapiens
tcagcagtatatttataaacaggaacctgtacagaagtgccctggaagaaggcctgctctaaattatccagtgtatggagaaacgacacaggttaggagacgttgctttgaacgtgctataggacctcctcaaacacacaccatcagaattcaatattcacctgccagactggcttatcaagacaaaggtgtccttcataatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttagactgatgagcaaaggaggagtcaactaatgaagaaatgaataataaatttttgacactg

SEQ ID NO: 56871 - DNA, 305 bp, Homo sapiens
  misc_feature 5: n = A,T,C or G
aagangccacacgttgtgcccgccgctgtggctctaaggcctaccaccttcagaagtcgacctgtggcaaatgtggctaccctgccaagcgcaagagaaagtataactggagtgccaaggctaaaagacgaaataccaccggaactggtcgaatgaggcacctaaaaattgtataccgcagattcaggcatggattccgtgaaggaacaacacctaaacccaagagggcagctgttgcagcatccagttcatcttaagaatgtcaacgattagtcatgcaataaatgttctggttttaaaaaatg

SEQ ID NO: 56872 - DNA, 183 bp, Homo sapiens
gaatgttttccaacggaaaatttgtgaatgaagttagaagatgtgaagaaatggatcgaaagcttcgatttgttgagaaagagataagaaaagctaacattccgattatggacaccggtgaaaacccagaggttcccttcccccgggacatgattgacttagaggccaattttgagaagattg

SEQ ID NO: 56873 - DNA, 139 bp, Homo sapiens
  misc_feature 139: n = A,T,C or G
tatactacggtcaatgctctgaaatctgtggagcaaaccacagtttcatgcccatcgtcctagaattaattcccctaaaaatctttgaaataggacccgtatttaccctatagcaccccctctaccccctctagagccn

SEQ ID NO: 56874 - DNA, 358 bp, Homo sapiens
gttatggcaagtttttggtaatgatgattcaatcattttgggaaattcttgcactgtatccaagttatttgatctggtgcgtgtggccctgtgggagtccactttcctctctctctctctctgttccaagtgtgtgtgcaatgttccgttcatctgaggagtccaaaatatcgagtgaattcaaaatcatttttgttttcctccttttcaatgtgatggaatgaacaaaaaggaaaaaattcaaaaaacccagtttgttttaaaaataaataaataaagcaaatgtgccaattagcgtaaacttgcggctctaaggctcctttttcaacccgaatattaataaatcatgagagttctc

SEQ ID NO: 56875 - DNA, 472 bp, Homo sapiens
catctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggcttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatatttttaaatatccacagtactcactttttccaaatgatcctagtaattgcctagaaatatctttctcttacctgttattt

SEQ ID NO: 56876 - DNA, 500 bp, Homo sapiens
  misc_feature 8, 9, 28, 47, 447, 450: n = A,T,C or G
tccggccnntattggccggggtggagantactgggttgaccctaacnaaggatgcaaattggatgctatcaaggtattctgtaatatggaaactggggaaacatgcataagtgccaatcctttgaatgttccacggaaacactggtggacagattctagtgctgagaagaaacacgtttggtttggagagtccatggatggtggttttcagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggagggatnggntgcacgaaacacactggggaatggagcaaaacagtctttgaatatcgaac

SEQ ID NO: 56877 - DNA, 278 bp, Homo sapiens
gctgggcctgaataagggttatcgaatggtggtgaatgaaggttcagatggtggacagtctgtctatcacgttcatctccatgttcttggaggtcggcaaatgcattggcctcctggttaagcacgtttttgggataattttctcttctttaggcaatgattaagttaggcaatttccagtatgttaagtaacacacttatttttgcctgtgtatggagagattcaagaaataattttaaaaccgcatacataataaaagacattgttgcatggctgg

SEQ ID NO: 56878 - DNA, 472 bp, Homo sapiens
atttatgaaaaagtgaacacatatggaattctgccttgtcattatcccctaaagaacacactataactacctacataacatttacattgtacttggtatcataagaaatctagagatgatttaaagtatgtgacagtgtggatgtaggtgtataaaatactattatacatcattttatggaagggtcttgagcatctgtagatttttgtgtctgagggttcctagaaccagtaccccacaaatacaggggaacaactgtaatgagttcctagtaaactaggctgaagtattataactgtacacaaaataatttaaggcagaatgattaaataatatatagcagtatgtataagaagtgaagataattgaaaattaaattgatagggaaagacatgacaaatataatgaaatcaatggaaaagttaaaactttagcaagatgtacaagcaaggattgggtagatttcatctga

SEQ ID NO: 56879 - DNA, 307 bp, Homo sapiens
caagggccagtatcttgatgcccaacattggttatggaagcaacaaaaaaacaaagcacatgctgcccagtggcttccggaagttcctggtccacaacgtcaaggagctggaagtgctgctgatgtgcaacaaatcttactgtgccgagatcgctcacaatgtttcctccaagaaccgcaaagccatcgtggaaagagctgcccaactggccatcagagtcaccaaccccaatgccaggctgcgcagtgaagaaaatgagtaggcagctcatgtgcacgttttctgtttaaataaatgtaaaaactg

SEQ ID NO: 56880 - DNA, 357 bp, Homo sapiens
attctaaaagggctttgttcctttccttttctttaacttctctgagatactgatttgtaaattttgaaaattagttaaaatatgcagttttttgagcccacgaatagttgtcatttcctttatgtgcctgttagtaaaaagtagtattgtgtatttgctcagtatctgaactataagcccatttatgctgttccatacaaaagctatttttcaaaaattaatttgaaccaaaactactactatagggaaaagatgccaaaacatgtcccctcacccaggctaaacttgatactgtattattttgttcaatgtaaattgaagaaaatctgtaagtaagtaaaccttaagtgtgaaccg

SEQ ID NO: 56881 - DNA, 283 bp, Homo sapiens
gaagagctattcaaatatggtgcagagagcagcaatgggttggagactatcagctcgctctgggccacgctttaaggaagctcttggagggcctgcttgggattacagaaatattattgaaaagttacaggatgtagtggcctccttggagcaccagttcagcccaatgatgcaggctgaattctcagtgttggttgatgtattgtacagtccagaactgctgttccctgagggaagcgatgcaagaataagatgtggcgctttcatgtcgaagttgattaat

SEQ ID NO: 56882 - DNA, 500 bp, Homo sapiens
  misc_feature 3, 20: n = A,T,C or G
tanggaccgggggtctgagnaacatttacattatagataagtagtacatggtggataacttctacttttaggaggactactctcttctgacagtcctagactggtcttctacactaagacaccatgaaggagtatgtgctcctattattcctggctttgtgctctgccaaacccttctttagcccttcacacatcgcactgaagaatatgatgctgaaggatatggaagacacagatgatgatgatgatgatgatgatgatgatgatgatgatgaggacaactctctttttccaacaagagagccaagaagccattttttttccatttgatctgtttccaatgtgtccatttggatgtcagtgctattcacgagttgtacattgctcagatttaggtttgacctcagtcccaaccaacattccatttgatactcgaatgcttgatcttcaaaacaataaaattaaggaaatcaaagaaaatgggtttaaaggactcactt

SEQ ID NO: 56883 - DNA, 475 bp, Homo sapiens
  misc_feature 9, 17: n = A,T,C or G
gattaaagnacctcagnaggaaattatttaggttgtaatgcacaggcaactgtgagaaactgttgtgccaaaaatagaattccttctagtttttcttgttctcatttgaaaggagaaaattccactttgtttagcatttcaagcttttatgtatccatcccatctaaaaactcttcaaactccacttgttcagtctgaaatgcagctccctgtccaagtgccttggagaactcacagcagcacgccttaatcaaaggttttaccagcccttggacactatgggaggagggcaagagtacaccaatttgttaaaagcaagaaaccacagtgtctcttcactagtcatttagaacatggttatcatccaagactactctaccctgcaacattgaactcccaagagcaaatccacattcctcttgagttctgcagcttctgtgtaaatagggcagcttgtcgtctatgccgtagaatc

SEQ ID NO: 56884 - DNA, 463 bp, Homo sapiens
ggagcagaataagcaggagaaagcagcatcttgcctggatgagccgggggacacagaagagaagcccactatctcatttaatctttacaactctcttgcaaggttccctggttgtgaaaatacatgagataaatcatgaaggccactatcatcctccttctgcttgacaagtttcctgggctggaccgtttcaacagagaggcttatttgactttatgctagaagatgaggcttctgggataggcccagaagttcctgatgaccgcgacttcgagtcctccctaggcccagtgtgccccttccgctgtcaatgccatcttcgagtggtccagtgttctgatttgggtctggacaaagtgccaaaggatcttccccctgacacaactctgctagacctgcaaaacaacaaaataaccgaagtcaaagatggagactttaagaacctgaagaaccttcacgcatt

SEQ ID NO: 56885 - DNA, 470 bp, Homo sapiens
gccaagaaggcggatgaagccacgcgacgtgttgtgtctgagatcccggtgctgaagactaacgccggaccccgagatcgtgagttgtgggtgcagcgacctgaaggaggaatatcagtcccttatccggtatgtggagaacaacaagaatgctgacaacgattggttccgactggagtccaacaaggaaggaactcggtggtttggaaaatgctggtatatccatgacctcctgaaatatgagtttgacatcgagtttgacattcctatcacatatcctactactgccccagaaattgcagttcctgagctggatggaaagacagcaaagatgtacaggggtggcaaaatatgcctgacggatcatttcaaacctttgtgggccaggaatgtgcccaaatttggactaactcatctcatggctctggggctgggtccatggcttggcagtggaaatccctgatctgatt

SEQ ID NO: 56886 - DNA, 375 bp, Homo sapiens
  misc_feature 16, 59: n = A,T,C or G
ggctgcagaacaaatnagccatccttgctaatttcaaaaactaccagttctttattggngaaaacatgaatccagatggcatggttgctctattggactaccgtgaggatggggtgaccccatatatgattttctttaaggatggtttagaaatggaaaaatgttaacaaatgtggcaattattttggatctatcacctgtcatcataactggcttctgcttgtcatccacacaacgccaggacttaagacaaatgggactgatgtcatcttgagctcttcatttattttgactgtgatttatttggagtggaggcattgtttttaagaaaaacatgtcatgtaggttgtctaaaaataaaatgcatttaaactc

SEQ ID NO: 56887 - DNA, 372 bp, Homo sapiens
gaagaagtgagagatatttcaagttgaaaatcagtctgcacaagaaaaaggttaaagtgagagtttctgatggggagcaggcaaaaaagagcagggaaatttccttaaaggaatttgggtgcaaggatcaacgtaagccaagaatgtcttcagatgctaaagaatttatcagtatcataaatcctcataatcttaaaggtaaatccttgggccaagtgtcattgacacacccttactctgaatgtgattttaaacttaaagaagtggctagaaataacatgggaaatgatacaaatgaagagcaggaaaaagcagtgacaaaaatagaaattatttctcatatgaagcagtctacctcatgtctagattctg

SEQ ID NO: 56888 - DNA, 262 bp, Homo sapiens
  misc_feature 31, 261, 262: n = A,T,C or G
acagcagcagcacttcccaagcctgctgacnacagtcacatcacccatcagcacatggaaggcccctggtatggacactgaaaggaagggctggtcctgcccctttgagggggtacaaacatgactgggacctaagagccagaggctgtgtagaggctcctgctccacctgccagtctcgtaagagatggggttgctgcagtgttggagtaggggcagagggagggagccaaggtcactccaataaaacaagctcatggcnn

SEQ ID NO: 56889 - DNA, 196 bp, Homo sapiens
  misc_feature 12: n = A,T,C or G
taattgcggccnttatggaccgggattttggaattggtgtatatcatgaagccttgctgaactaagttttgtgtgtatatatttaaaaaaaaatcagtgtttaaataaagacctatgtacttaatcctttaactctgcggatagcatttggtaggtagtgattaactgtgaataataaatacacaatgaattcttc

SEQ ID NO: 56890 - DNA, 205 bp, Homo sapiens
  misc_feature 10, 19, 27, 31, 33, 38, 40, 49, 159: n = A,T,C or G
agcaggtatntccgtcaanctcaatgnagcncncaccnanaaaggaganacaattatgttcctgaggtctcagccttggatcaggagattattgaagtagatcctgacactaaggaaatgctgaagcttttggacttcggcagtctgtccaaccttcangtcactcagcctacagttgggatgaatttcaaaacgcctcggggac

SEQ ID NO: 56891 - DNA, 405 bp, Homo sapiens
  misc_feature 3, 33, 63: n = A,T,C or G
ctntggcccgggccaaccttgagaagtttgacntaaagagcttctgcaagatcctggggcccnttatcctactccaagatcaagcatttgcgtttggatggcaatcgcatctcagaaaccagtcttccaccggatatgtatgaatgtctacgtgttgctaacgaagtcactcttaattaatatctgtatcctggaacaatattttatgggttatgtttttctgtgtgtcagttttcatagtatccatattttattactgtttattacttccatgaattttaaaatctgagggaaatgttttgtaaacatttattttttttaaagaaaagatgaaaggcaggcctatttcatcacaagaacacacacatatacacgaatagacatcaaactcaatgctttatttgt

SEQ ID NO: 56892 - DNA, 472 bp, Homo sapiens
atatgttaaatactgagtctagttttcttcctcttatggagcttcatggaataagaaactaatctagtgcaaatgaagattaaatatttctgggtgatggagagatagtcaacaaatttatttatccatcctctgcacatcagtccactggagcaggagttctacacattaaaaatgtaatgggatcagcctagcattgtttggtgttcttttgttgtattttttagaatgggggtgggggcctaagtgtccttatgaagctgtggtccacgacaggagcttgttgggggagtaccagggttctgctgctttcctgcatctgagcaacacaacagggatcatcagttttaaatagagtagccctcacaatcaaaatatcatagaatatattgtaaaggttatgttgctaattttcctttgaaatataaaatatttttaagcttttttgtcaaaaagtggtaacatcttaata

SEQ ID NO: 56893 - DNA, 265 bp, Homo sapiens
  misc_feature 30: n = A,T,C or G
atgtacttgtcaattctgtgtcaataagtnttttagctatcatgatagtctcaattgtttgaaacaaaaatatttctttagcagctttatatggcagaagcattttccacattttaaggtgtcaagatttaccctttgtgatgatatatgtgttctcaaggtttaattacactttatcataaaatatagttattactggattaaaaatgactgttttgttaacagactgataaatatctttgaagggctcaaaatgcagtcatgg

SEQ ID NO: 56894 - DNA, 357 bp, Homo sapiens
gggaatgggagaggggaagtcttggcagggaaatcccttttggcccacagtttacaaacccagtatcatgtctgtctgtgtgtctctcaaggtgagagtctgatttttataccaaagaggaaatgatttttttcatattttgtttgtctatattatataaatatatatatacagttatatatatatatattattttttggttctctctcgttttttagggagggaagaaagtaccaagttgcattgagctgtaattaaggaacattataatttatgacacatttctatacttgcaaaaattatatcattttatggatataagagaaaaatgcctttttataaaatttcaatttctga

SEQ ID NO: 56895 - DNA, 288 bp, Homo sapiens
gcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggggggtgattattttttatactgtatgtgccaaagctttactactgtggaaagacaactgttttaataaaagatttacatt

SEQ ID NO: 56896 - DNA, 385 bp, Homo sapiens
  misc_feature 120: n = A,T,C or G
ggttccctagggtacacttgctctagccatactttaaaggccactgttgcaaagtctacattttatgctgaatctgcattctgtcaggcacccgtagaaagacctcagtacatgctttgncctctcctttgctccctttttccaatttcttattgcatatcattttgttgtaatacaggaaagcagcatttttaaatgtccgtgttaagaattggcccactggtaccaactcacctctattttgtcagttcatagttgaagattttgttttatttcaaaaacaaagtacatttttgaaataatgtttcagaataaaataatctcacttttaagtgatccattttaaaatttgtaattcaataaagttttttttgttgttaaacat

SEQ ID NO: 56897 - DNA, 119 bp, Homo sapiens
  misc_feature 119: n = A,T,C or G
acagctctttggacactaggaaaaaaaccttgtagagagagtaaaaaatttagcacccatagtaggcctaaaagcagccaccaattaagaaagcgttcaagctcaacacccactaccgn

SEQ ID NO: 56898 - DNA, 499 bp, Homo sapiens
  misc_feature 2, 441: n = A,T,C or G
gnggccgggaggggaatcaaagcaaatgcattcaaaaaactgaataacctcaccttcctctacttggaccataatgccctggaatccgtgcctcttaatttaccagaaagtctacgtgtaattcatcttcagttcaacaacatagcttcaattacagatgacacattctgcaaggctaatgacaccagttacatccgggaccgcattgaagagatacgcctggagggcaatccaatcgtcctgggaaagcatccaaacagttttatttgcttaaaaagattaccgatagggtcatacttttaacctctattggtacaacatataaatgaaagtacacctacactaatagtctgtctcaacaatgagtaaaggaacttaagtattgggtttaatattaaccttgtatctcatttttgaaggaatttaatatttttaagcaanggatgttcaaaatcttacatataataagtaaaaagtaagactggaatgtctacgttcg

SEQ ID NO: 56899 - DNA, 462 bp, Homo sapiens
gatatcatctaatttccaaacataagggaattttagagtcatctttttataactggtatagcttaattccactgtggtcagaaaacagactttaaaagatttcaggcctttgaaatttgttaaggtttgctttgtggtttagtatatgtcaattttagtaactgctccttatgcactgaaaagaacatttattctttctttgcagtgttttataaacatcaattagattaggtttgtttattgcattgctttggtgttctttgttcttactgatttccctccctgcttattctactcattattatgagaagtatgttaaaagtttttcacactgatgtgcattcaactattacttttagttctataaatttttaccttatgtattttgaaactatgttatcagatgcatacaaatttagagattgttatatcttcctggtgaataaaaccttatattattat

SEQ ID NO: 56900 - DNA, 264 bp, Homo sapiens
  misc_feature 12, 21: n = A,T,C or G
tgcggccattanggaccgggnatacaggggcagctgccaaattgatgtattatatattgtggtttctgtttcttgaaagaatttttttcgttatttttacatctaacaaagtaaaaaaattaaaaagagggtaagaaacgattccggtgggatgattttaacatgcaaaatgtccctgggggtttcttctttgcttgctttcttcctccttaccctaccccccactcacacacacacacacacacacacacacacacacacaca

SEQ ID NO: 56901 - DNA, 488 bp, Homo sapiens
  misc_feature 8, 35, 38, 457, 477: n = A,T,C or G
gaaggaanctccacgaaggggaaatccagggagcngcnggctcagaattcaggaacagcatgtccaaatcgatgtggatgtttccaagcctgacctcacggctgccctgcgtgacgtacgtcagcaatatgaaagtgtggctgccaagaacctgcaggaggcagaagaatggtacaaatccaagtttgctgacctctctgaggctgccaaccggaacaatgacgccctgcgccaggcaaagcaggagtccactgagtaccggagacaggtgcagtccctcacctgtgaagtggatgcccttaaaggaaccaatgagtccctggaacgccagatgcgtgaaatggaagagaactttgccgttgaagctgctaactaccaagacactattggccgcctgcaggatgagattcagaatatgaaggaggaaatggctcgtcaccttcgtgaataccaaganctgctcaatgttaagatggnccttgacattg

SEQ ID NO: 56902 - DNA, 128 bp, Homo sapiens
gcaaaatgtaatgatgagcttggtggagaagaatgagtcgttcttggaatacctatgtgcagccactacccatctcaatgtcaccttgtttgcattcttggatagcttgtatatgtagtagtttgatg

SEQ ID NO: 56903 - DNA, 404 bp, Homo sapiens
  misc_feature 397: n = A,T,C or G
gggaggaggaggaggttgagacgttcgcctttcaggcagaaattgcccagttgatgtcattgatcatcaatactttctactcgaacaaagagatctttctgagagagctcatttcaaattcatcagatgcattggacaaaatccggtatgaaagcttgacagatcccagtaaattagactctgggaaagagctgcatattaaccttataccgaacaaacaagatcgaactctcactgttgtggatactggaattggaatgaccaaggctgacttgatcaataaccttggtactatcgccaagtctgggaccaaagcgttcatggaagctttgcaggctggtgcagatatctctatgattggccagttcggtgttggtttttattctgcttatttggntgctgag

SEQ ID NO: 56904 - DNA, 486 bp, Homo sapiens
atggccgggggttaaaagttaaaaataaaacactaatgttttaagagctttagtattttgcttagcattcaatactagcagattcataactgatgcctgttcaaaaacactgttggtggaatcttttatttcatgtgtatgtaactactaaatttttcatgactgaagaggttatagcacatattagttagtgctaatattctactgaatataatttaagcaatgggctaaggtccaagaaacatagcaattatatctacaaataatctattaacatgatcttcagaatctctagtttttgttctatagataaagccataagaatcctttcctaccagtttttcctatatcatttagatattatttcctagaaaacaggatgcctgtcactgataagttagagaaaacacccaaattatacttgcactatggaaagacgacatgaatatgttgactgggtactttctactctcatttttgttagcc

SEQ ID NO: 56905 - DNA, 410 bp, Homo sapiens
atggccggggggggtaaggccaaattgccaacacttgttaaaagattaatactcttaagtggcactctgatacctttccaacttgtcatcagaaaggaatcaataattaccaactgttgtatttagaccaacttacaatatctagctcattagaagccaggatctagaaagctccttctaagccatttaagatattcttacattgagcttcatattatagaactttataggattggatattttacaatagaataatttagcctcaggactgagaatgtggaagctgaataaattagctttaaatacatcattaaaatcttatgcacaataagctcattagattctagttttctcctttagaataccaatgccacagacactacaggagataatgaaaggatcaagttgtg

SEQ ID NO: 56906 - DNA, 268 bp, Homo sapiens
aaggaagatcccagtgtctgagtgaactaacagtcctgctttcagccaccatttgcacaagacacccagcactgaaagtcccgctgccaggagcaagggatcctttggaagcacccgccctttgtgccttgttgggggaaaccggtgacgcagaagtgagtgtggatacaccagagtttgcattggaaggaatgagtgtcacgtggggagggaaggggccagtggaccttttgtaagctttccactcaataaaatgaacctgtgtggc

SEQ ID NO: 56907 - DNA, 263 bp, Homo sapiens
  misc_feature 11, 260: n = A,T,C or G
agagctcaaanatctgttagagtgtgaggaaaaatagtctatttggaaacaaagatagatgggatgtcattcattgaggtttgcagcatttttgatgttctagagaatttgctctaaaatctggttaatgctaatgtttgtaataggataacttttcttcagataatccttcacattcccactatattctgggagttacagaaaatgagcaaagtatgtatgttaagttatagtggtcatagcaaagcaaatgtatagtnacc

SEQ ID NO: 56908 - DNA, 472 bp, Homo sapiens
gaggcattgaggcagcccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttaggagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttggaaggcgatcttttaaaaagagattaaaccgaagg

SEQ ID NO: 56909 - DNA, 347 bp, Homo sapiens
  misc_feature 4, 8, 31: n = A,T,C or G
aagnaagnatgatggaaatcatgacccgagnaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctggaaaagccactggggacgagacaggtgctaaagttgaacgagctgatggatatgaaccaccagtccaagaatctgtttaaagttcagacttcaaatagtggcaaataaaaagtgctatttgtga

SEQ ID NO: 56910 - DNA, 468 bp, Homo sapiens
tgatgaagctgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttca

SEQ ID NO: 56911 - DNA, 491 bp, Homo sapiens
  misc_feature 15: n = A,T,C or G
atctgtaactatgtnagtcgaataattgaacccctgacctctagatgttcaaaattccgcttcaagcctctgtcagataaaattcaacagcagcgattactagacattgccaagaaggaaaatgtcaaaattagtgatgagggaatagcttatcttgttaaagtgtcagaaggagacttaagaaaagccattacatttcttcaaagcgctactcgattaacaggtggaaaggagatcacagagaaagtgattacagacattgccggggtaataccagctgagaaaattgatggagtatttgctgcctgtcagagtggctcttttgacaaactagaagctgtggtcaaggattaatagatgagggtcatgcagcaactcagctcgtcaatcaactccatgatgttggttgtagaaaataacttatctgataaaccagaagtctattatcacagaaaaacttgcccgaagttgacaaatgcctagcagatggt

SEQ ID NO: 56912 - DNA, 314 bp, Homo sapiens
  misc_feature 49: n = A,T,C or G
gactggcgcgggttgagttccctgttgcccttggtctcggggtcgctgncggcgctgaggctgcagctatcatggtgaacttacttcagattgtgcgggaccactgggttcatgttcttgtccctatgggatttgtcattggatgttatttagacagaaagagtgatgaacggctaactgccttccggaacaagagtatgttatttaaaagggaattgcaacccagtgaagaagttacctggaagtaaagactggctagattatcgaatgttcacattttaaagttctgagagaaataaaaacatgaagaattt

SEQ ID NO: 56913 - DNA, 473 bp, Homo sapiens
  misc_feature 432: n = A,T,C or G
gggaccagtatctaacatcttgaatactctgccctctagaagccttcagccttaatggaaggttggatccaaggagggtgtaatggagcatcaagccactcggcggcagcatggagctataactaagcatcctttagggttctgcctctccaggcatttagccctcacattagatctagttactgtggtatggctaatacctgtcaacatttggaggcaatcctaccttgcttttgcttctagagcttagcatatctgattgttgtcaggccatattatcaatgtttacttttttggtactataaaagctttctgccacccctaaactccaggggggacaatatgtgccaatcaatagcacccctactcacatacacacacacctagccagctgtcaagggcagaatgaatctatgctggataagaaatggnggaactgcgttatgaagagctaatttactggacaaagaatt

SEQ ID NO: 56914 - DNA, 202 bp, Homo sapiens
gaaggaggttgggaggtggaggcccagcatcccgcgcagatgacaccatcaaccgccagagtcccagacaccggttttcctagaagcccctcacccccactggcccactggtggctaggtctccccttatccttctggtccagcgcaaggaggggctgcttctgaggtcggtggctgtctttccattaaagaaacaccgtgc

SEQ ID NO: 56915 - DNA, 471 bp, Homo sapiens
  misc_feature 313, 315, 455, 458: n = A,T,C or G
atcacttaaaatattctatgtgatcggtatggagatgtggtcatatgcaaaaggtttcatttctttgttcccattcataggtctcactgaagtcctgagcaaataaaattactctttaggctactgtggcatttgcctcagctgataagcttgaagatgtagtgtgtcatgctatttctcggtaagggtcattttcaagttacactatggatactctcaacctaaataatagcaagtcggctgtgttaggacattttagatgcagaaaaaagaaaatgagccatgtgttcttgggtaattcttaaaatatttnangtgttatcttttgtgctttgaaagttattattttaaccaaattaaataagcagtattttacagaactttttattgacttctgtcttacctcaggctgtggccttaatttcagaaactaatttcttagtagaaatgtattnggnaatgattacacta

SEQ ID NO: 56916 - DNA, 486 bp, Homo sapiens
gctagtaattgatttatttttcttcaataaagttgcataaaccaatgagttagctgcctggattaatcagtatgggaaacaatcttttgtaaatgcaaagctgttttttgtatatactgttgggatttgcttcattgtttgacatcaaatgatgatgtaaagttcgaaagagtgaatattttgccatgttcagttaaagtgcacagtctgttacaggttgacacattgcttgacctgatttatgcagaattaataagctatttggatagtgtagctttaatgtgctgcacatgatactggcagccctagagttcatagatggacttttgggacccagcagttttgaaatgtgtttatggagtttaagaaatttattttccaggtgcagcccctgtctaactgaaatttctcttcaccttgtacacttgacagctgaaaaaaaacaacatgggagtaataatgggtcaaaatttgcaaaataaagta

SEQ ID NO: 56917 - DNA, 432 bp, Homo sapiens
catatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaggttaagggcaagattcttgccaagagaattaatgtgcgtattgagcacattaagcactctaagagccgagatagcttcctgaaacgtgtgaaggaagatgatcagaaaaagaaagaagccaaagagaaaggtacctgggttcaactaaagcgccagcctgctccacccagagaagcacactttgtgagaaccaatgggaaggagcctgagctgctggaacctattccctatgaattcatggcataataggtgttaaaaaaaaaaataaaggacctctggg

SEQ ID NO: 56918 - DNA, 500 bp, Homo sapiens
  misc_feature 8, 13, 50, 445: n = A,T,C or G
ccaggggnttcgnccttatggccggccttcttcttcttttttaactgaanctgaatccttcctttcttctgccatctacttgcttaaattgtgggcaaaagagaaaaagaaggattgatcagagcattgtgcaatacagtttcattaactccttccctcgctcccccaaaaatttgaatttttttttcaacactcttacacctgttatggaaaatgtcaacctttgtaagaaaaccaaaataaaaattgaaaaataaaaaccataaacatttgcaccacttgtggcttttgaatatcttccacagagggaagtttaaaacccaaacttccaaaggtttaaactacctcaaaacactttcccatgagtgtgatccacattgttaggtgctgacctagacagagatgaactgaggtccttgttttgttttgttcataatacaaaggngctaattaatagtatttcagatacttgaagaatgttgatggtgctagaagaattt

SEQ ID NO: 56919 - DNA, 178 bp, Homo sapiens
gaggtaggttttatttgtggagagagagttgaagattagggaaccagtgattttaattatgctactttttcttctaagagataaattgatatatctttcagtgtcatgaaaaacatgaatgttgtacaattttcttcctcaaaaaaactttttaaatgtaagtatccttatttttttt

SEQ ID NO: 56920 - DNA, 471 bp, Homo sapiens
  misc_feature 26: n = A,T,C or G
atagcatgcggcactggccttttttntcctactcattacaggcaaaactcatgtcttatttatgaggattttatagatcattttctgtaacaggtgacaaaagcagaaaagaatgaagaggctgaagtatgaactacccttggagcccatatacatgatataggcaatttcttttgtatgttaattcggtcaaaaatactacccacttgatgttttctaatctgatgtgagctcatgttacacagacttttagtaagtaacccgtgactagaaaataaactggatgcttaggagagagtgtcagatgtataagatgctaataaaacctgtttaatattattgttagctgtaagtttttgggaaatactgaacaaattagtccacaatcaagtgtctacttttcccttcactgtagggcctctccctgcacagagcagtctgtttagctgtgaacaccacaatctgcagatg

SEQ ID NO: 56921 - DNA, 352 bp, Homo sapiens
  misc_feature 18, 60, 65, 67, 68, 83, 104, 139, 228: n = A,T,C or G
gtacattccgttgaaggnacaccagactgcggaatttgcggctttggcagattgaaatcntggcngnnccagaaagtgatgcncaataccagttcactggtatnaaaaaatatttcaactcttatactctcacaggtanaatgaactgtgtactggccacatatggaagcattgcattgattgtcttatatttcaagttaaggtccaaaaaaactccagctgtgaaancaacataaatggattttaaactgtctacggttcttaacctcatctgttaagttcccatgcctggagaagctaatgccaactcatcatgtgataattcaatttgtacaataaattatgaacctac

SEQ ID NO: 56922 - DNA, 152 bp, Homo sapiens
  misc_feature 15: n = A,T,C or G
accgggggcatgtangtaaatgataagtgtttgaggtgatggaatgcttaccctgatttcatcattacacaaggtatacatgtatcgaaatatcaccttgtacttcatatatatgtacagttatgtctcaattaaaaatttaaaaaactctg

SEQ ID NO: 56923 - DNA, 404 bp, Homo sapiens
  misc_feature 273, 276, 394: n = A,T,C or G
ggcggacgaatcggcgtttgccgaggctggcatagatttggctgtctccgctcatagctgcttttggcgcgaaagatgccgggtctggttgactcaaaccctgccccgcctgagtctcaggagaagaagccgctgaagccctgctgcgcttgcccggagaccaagaaggcgcgcgatgcgtgtatcatcgagaaaggagaagaacactgtggacatctaattgaggcccacaaggaatgcatgagagccctaggatttaaaatatgaaatggnggnctgctgtgtgaataaataattcctgaagaatgaagaagattaatttttgggagttctttgacgaactttgatatgtggaaaaagtatttataatttattgtaagaagaaagtaaaatnttactagtgg

SEQ ID NO: 56924 - DNA, 464 bp, Homo sapiens
  misc_feature 118, 119, 168, 182, 201, 226, 228, 275, 320, 321, 363, 400,408, 417: n = A,T,C or G
taacttgtagaaatattgtatatttattttctgcttatttaatgtcttaatttctgaaaagtattaacatccctgtctcccactcccctgccgtcccatgaagttaactcctgagagnngtcgggggtgactggagagctcattgcagaccacgtggtcctccagggnggctctccaccttngggtcctggtatttccagncaagtgggtttcaattcttgggctntnccgcccttatgatgaagtgtgtgtttgatgccagtgagaaactcagnctggcaggctacaaaattctactccaagaaatacccagcaacctnntgtttgttccaaagcaactagcttatcatgcaagcaaatttngctgactccaggctttatctttaggaaaacaaaaaanccaaagtnttatcagcnggggggaaagatttttctattgaaaatttatccctgacacctcagcg

SEQ ID NO: 56925 - DNA, 464 bp, Homo sapiens
actcttaagggttgtacattctgtatgtttggacaaatctgtaatgtatatatctatcaatgtagtatcattcagaatagtttcattactattttattttactgtctccatggttttatctttttcaaaatgtcataatcatacagtttgtaggtcttttcatactgtctttttttacttagtagtgtgcatttaaggtttctccctgtcttttcatgacttcatagctcatatctttcagtgctgaatagtattctattgctgaggtgtatcacaagttcatctgttcacctactgaaggacatcttgtttgcttccaggttatggcagttatgaataaatctgctataaacatccttgtgcagttgtttgggtagataagtgtttaattcctttgggcaaatatgcaaagagtgtgatcttatggtaagagtgcttaggttttgtaaagaaaccacgaaatg

SEQ ID NO: 56926 - DNA, 207 bp, Homo sapiens
  misc_feature 2, 3: n = A,T,C or G
annaatggaccgggctccctttctttctcccagctttgcctcccttatcccaccctcgaggcagggaaaagccatctattcttctgcagcctcaggagcgagacttcaaggactcagtttggttccacccagttgaaagacacccagtgcacacccaaactcctggccttctgtggtttccctttgctccagaaacacagatgtgtc

SEQ ID NO: 56927 - DNA, 284 bp, Homo sapiens
  misc_feature 283: n = A,T,C or G
atggtgctaatgtactttcacttttaaactctagatcagaattgttgacttgcattcagaacatacatgcacaaaatctgtacatgtctcccatcagaaagattcattggcatgccacaggggattctcctccttcatcctgtaaaggtcaacaataaaaaccaaattatggggctgcttttgtcacactagcatagagaatgtgttgaaatttaactttgtaagcttgtatgtggttgttgatcttttttttccttacagacacccataataaaatatcatng

SEQ ID NO: 56928 - DNA, 477 bp, Homo sapiens
  misc_feature 3, 13, 472, 474, 475: n = A,T,C or G
tcnatggccgganagtcctaaacatatatgcacctaacactggagctcccaaatttataaaacaattactgatagacctaagaaatcagatagacagcaacacaacaataatggaggacttcagtactccactgacagcactagacaggtcaacaagacagaaagtcaacaaagaaacaatggatttaaactataccttggaacaaatggacttaacagatatatgcagaacattccatccaataaccgcagaatacacattctattcaagagtgcatggaactttctccaagatagaccatatgataagccataaaacaagccttaataaatttaagaatattgaaattctgtcaagccctctctcagaccacagtggaataaaactggaaagcaactccaaaaggagccttcaaaaccatgcaaatacatagaaattaaataacctgttcctgaatgagcattgagtccnanncg

SEQ ID NO: 56929 - DNA, 500 bp, Homo sapiens
  misc_feature 2, 3, 484: n = A,T,C or G
cnnggggggggggggcaaagagaggccgggggggctggcgctgtgacaactgccgcagacctgggggtgaacccagccccgaaggcactactggccagtcctacaaccagtattctcagagataccatcagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcaccaccctgggagtttcctgagggttttctcataaatgagggctgcacattgcctgttctgcttcgaagtattcaataccgctcagtattttaaatgaagtgattctnagattccgggtttggg

SEQ ID NO: 56930 - DNA, 153 bp, Homo sapiens
  misc_feature 2, 21: n = A,T,C or G
cnggccgggggcatgaagaantgataagtgtttgaggtgatggaatgcttaccctgatttcatcattacacaaggtatacatgtatcgaaatatcaccttgtacttcatatatatgtacagttatgtctcaattaaaaatttaaaaaactctg

SEQ ID NO: 56931 - DNA, 500 bp, Homo sapiens
gaccggggtatttcaaatgcttctgatgctttagataagataaggcctaatatcactgactgatgaaaatgctctttctggaaatgaggaactaacagtcaaaattaagtgtgataaggagaagaacctgctgcatgtcacagacaccggtgtaggaatgaccagagaagagttggttaaaaaccttggtaccatagccaaatctgggacaagcgagtttttaaacaaaatgactgaagcacaggaagatggccagtcaacttctgaattgattggccagtttggtgtcggtttctattccgccttccttgtagcagataaggttattgtcacttcaaaacacaacaacgatacccagcacatctgggagtctgactccaatgaattttctgtaattgctgacccaagaggaaacactctaggacggggaacgacaattacccttgtcttaaaagaagaagcatctgattaccttgaattggatacaattaaaaatctcg

SEQ ID NO: 56932 - DNA, 488 bp, Homo sapiens
atctgctttaagaattaacgaaagcagtgtcaagacagtaaggattcaaaccatttgccaaaaatgagtctaagtgcatttactctcttcctggcattgattggtggtaccagtggccagtactatgattatgattttcccctatcaatttatgggcaatcatcaccaaactgtgcaccagaatgtaactgccctgaaagctacccaagtgccatgtactgtgatgagctgaaattgaaaagtgtaccaatggtgcctcctggaatcaagtatctttaccttaggaataaccagattgaccatattgatgaaaaggcctttgagaatgtaactgatctgcagtggctcattctagatcacaaccttctagaaaactccaagataaaagggagagttttctctaaattgaaacaactgaagaagctgcatataaaccacaacaacctgacagagtctgtgggcccacttcccaaatctctggaggatct

SEQ ID NO: 56933 - DNA, 395 bp, Homo sapiens
  misc_feature 2, 10, 22, 29, 31, 58, 331: n = A,T,C or G
anccctcaancggggcactganaagcaancntggtgagaaggctcctatgacttctanaagtacatctacttggagaatacccagcaggaagagacgtttcagcagtagtgacttttcagacctgagtaatggagaagagcttcaggaaacctgcagctcatccctaagaagagggtcaggtaaagaagattaggatgccaagacttggcctgcagaatgtcaggaatgtgaattaaaagctgctgtttccagacgctttttattctgagcaccttcactaccttgtatccagttcatctgggaactcctttttgcattttagaaaatggnaagaggcaggaaattatgataaactcatgtttaacagaaagagtttcactgactaaatgtatgt

SEQ ID NO: 56934 - DNA, 246 bp, Homo sapiens
  misc_feature 10, 11: n = A,T,C or G
aagggagtcnnttggagaaagccctgtattgtggtgttttaaccctaataaagttgatgagaagagaaggggagaggaagccgaacataaagcgggtcaagtgtagtgcatcttttgtatctcaggcgtggcttcttcagtggaccaagctgcaatgcggtattgacttgacagagcctctacttctgtcccaaaatggctccaaatgatttctgtactgcaaaataaagccaaattctggaaatt

SEQ ID NO: 56935 - DNA, 368 bp, Homo sapiens
  misc_feature 366, 367: n = A,T,C or G
agaattttaaaagatagaaatatatctattaaaaagaacaaaacaataatgtttagaaacgtaatgggtaggtttagttagacagaaaaattcagttaaggtgaaccattcctttccccgataatgctgggtaaatgtacttccactgtcacctttacccctacctgcatggagaaatggtccactgatgtgactaagcccagaagtgtttggtttctttttacttaaagttccttcttccagatgagagtcacgtctctgagacgaaacaaggatggatagcctcgaaggcttctttcaagcttctgacactaagctctgaaagttagcagcactcagcaatttggtactcactcatagaagtcnng

SEQ ID NO: 56936 - DNA, 367 bp, Homo sapiens
  misc_feature 138, 177: n = A,T,C or G
gaagtacctaacatggaactaatctgtgggagcagtttattccagtatcacccagggtgcagccacaccaggactgtgttgaagggtgttttttttcttttaaatgtaatacctcctcatcttttcttcttacacagngtctgagaacatttacattatagataagtagtacatggnggataacttctacttttaggaggactactctcttctgacagtcctagactggtcttctacactaagacaccatgaaggagtatgtgctcctattattcctggctttgtgctctgccaaacccttctttagcccttcacacatcgcactgaagaatatgatgctgaaggatattggaagacacagatgatg

SEQ ID NO: 56937 - DNA, 490 bp, Homo sapiens
gctgcacacctggatctgagagagtagcacaatgtaggctgcacatggggctcatcctgaggagacctcctggcataatggagcactgggggtgaaggcagatagaagatagtcgggagactatgaacacacatgagaatgtgttgtgagaaaaaaagtcaaaactatcagggtgggcgaagggcagggggaagctgttgatggaatgaaaaataaccatcatgctttgtttggctcagtcataagcaatatttacttagtcatgaaaatgtaaatactaactatggatttaactaaaaatagagatataattatagtgtggatgtggaagtaggggagatggagctaaaatacctgtccagcaggaaataaacagataatgtctaaaatgggtaagtcaagcaacaaaaatagaggcatatgattttgtgataaaacagtcatgaccagaaggaacagctttaacagggacaagtagttgctttttgca

SEQ ID NO: 56938 - DNA, 116 bp, Homo sapiens
  misc_feature 44, 50, 95, 112: n = A,T,C or G
tggtgttcagttgtggcggttgctggtcagtaacagcccaagangcctgnggaatctgctggctcttcgtcagattgggcagaggacgataagcncctgcttcccgcacgcntttt

SEQ ID NO: 56939 - DNA, 490 bp, Homo sapiens
  misc_feature 73, 77, 261, 276, 310, 338: n = A,T,C or G
atgcaaataaatgggtcagtgttgaagaatggctccctgacaaatcatttctcttttgaaaaaaaaaaggccngagnggctgtcttaatatctggaacaggatcgaacctgcaagcacttatagacagtactcgggaaccaaatagctctgcacaaattgatattgttatctccaacaaagccgcagtagctgggttagataaagcggaaagagctggtattcccactagagtagttaatcataaactgtataaaaatcgngtagaatttgacagngcaattgacctagtccttgaagagttctccatanacatagtctgtcttgcaggattcatganaattctttctggcccctttgtccaaaagtggaatggaaaaatgctcaatatccacccatccttgctcccttcttttaagggttcaaatgcccatgagcaagccctggaaaccggagtcacagttactgggtgcactgtacactttgtagctg

SEQ ID NO: 56940 - DNA, 149 bp, Homo sapiens
ttgacacaaaatagactacgaaagtggctttaacatatctgaacacacaatagctaagacccaaactgggattagataccccactatgcttagccctaaacctcaacagttaaatcaacaaaactgctcgccagaacactacgagccac

SEQ ID NO: 56941 - DNA, 389 bp, Homo sapiens
  misc_feature 3, 368, 377: n = A,T,C or G
tantggcccggggattttaggtgtcggttgggtaggcagtcatggatcaggtactgcagtttgttgagccaagtcggcagtttgtaaaggactccattcggctggttaaaagatgcactaaacctgatagaaaagaattccagaagattgccatggcaacagcaataggatttgctataatgggattcattggcttctttgtgaaattgatccatattcctattaataacatcattgttggtggctgaatacattttggaagagagtttttcatcttagagattggtgaacaagtgtgagggtgtgagaaactcacagaatacaaatttgcctgtatgttttgtgggttttttttttttcctttcaanatgttttcnatttctaaatta

SEQ ID NO: 56942 - DNA, 250 bp, Homo sapiens
ggaggaagagaggagagataaaatggcttaagaatgcagtgaagtctcaaggccaagttgattggcaacacaaagggacagggcaatggtatttcaggtcatctgcttacaaaggagctatggcatgttggatcatttctaagcatctagctatcattattttagtgtttttgttgattttggacatctagaagtgcaaagtataatcaatttgagaataaaagacatgatgcaaataaagacaattact

SEQ ID NO: 56943 - DNA, 366 bp, Homo sapiens
gctttttcgtccttttccccggttgctgcttgctgtgagtgtctctagggtgatacgtgggtgagaaaggtcctggtccgcgccagagcccagcgcgcctcgtcgccatgtctcggaaaattgaggaaatcaaggacttcctgctcacagcccgacgaaaggatgccaaatctgtcaagatcaagaaaaataaggacaacgtgaagtttaaagttcgatgcagcagatacctttacaccctggtcatcactgacaaagagaaggcagagaaactgaagcagtccctgccccccggtttggcagtgaaggaactgaaatgaaccagacacactgattggaactgtattatattaaaatactaaaaat

SEQ ID NO: 56944 - DNA, 277 bp, Homo sapiens
  misc_feature 62, 72, 85, 94: n = A,T,C or G
gtccctttcagtcatttgctgtacttccctgtggcacgttaccatggaagccgctccagggngggtcagggngcaagctgctggngaggtttgnaagcatcaggctcacgggtgttcatgtgtgttcgtgcgtgtgtgtgccgtacgtgtatataactgaagtgtctgtacggaatgccctttgctggccatgggctggtcaccagattgttttgtaatgcccgccccttgcctcgatattgccagtttcttgtgcaataaactatcagcagctgtc

SEQ ID NO: 56945 - DNA, 247 bp, Homo sapiens
  misc_feature 11, 15: n = A,T,C or G
ccggtcaaganaganggaattaatgatggatggaccctggagggaatctccccagccgacttccactgggctgacagactttgctgaccacaggggaacgatgttcttttctttcttcatgatcagacataaacttagcatcttaatggaagaaaaatgaggggaacttcaattatgatttattaaagacaatttctattacaccctcctttatgacaagtgacattttagatgtaaaagtaaaaac

SEQ ID NO: 56946 - DNA, 326 bp, Homo sapiens
gctggcaacttagaggtgggagcagagaattctcttatccaacatcaacatcttggtcagatttgaactcttcaatctcttgcactcaaagcttgttaagatagttaagcgtgcataagttaacttccaatttacatactctgcttagaatttgggggaaaatttagaaatataattgacgggattattggaaatttgttataatgaatgaaacattttgtcatataagattcatatttacttcttatacatttgataaagtaaggcatggttgtggttaatctggtttatttttgttccacaagttaaataaatcataaaacttg

SEQ ID NO: 56947 - DNA, 478 bp, Homo sapiens
  misc_feature 7, 51, 142, 181: n = A,T,C or G
gcaaaanaggccggggatggactaatctgtgggagcagtttattccaggancacccagggaggcagccacaccaggactgtgttgaagggtgttttttttcttttaaatgtaatacctcctcatcttttcttcttacacagngtctgagaacatttacattatagataagtagtacatggnggataacttctacttttaggaggactactctcttctgacagtcctagactggtcttctacactaagacaccatgaaggagtatgtgctcctattattcctggctttgtgctctgccaaacccttctttagcccttcacacatcgcactgaagaatatgatgctgaaggatatggaagacacagatgatgatgatgatgatgatgatgatgatgatgatgatgaggacaactctctttttccaacaagagagccaagaagccatttttttccatttgatctgtttccaatgtgtccat

SEQ ID NO: 56948 - DNA, 363 bp, Homo sapiens
  misc_feature 362: n = A,T,C or G
aaccatcggttgtttggcagcagctttggacgtagcgcctgtgaactcaggaatgcacagttgacttgggaagcagtattactagatctggaggcaaccacaggacactaaacttctcccagcctcttcaggaaagaaacctcattctttggcaagcaggaggtgacactagatggctgtgaatgtgatccgctcactgacactctgtaaaggccaatcaatgcactgtctgtctctccttttaggagtaagccatcccacaagttctataccatatttttagtgacagttgaggttgtagatacactttataacattttatagtttaaagagctttattaatgcaataaattaactttgtnc

SEQ ID NO: 56949 - DNA, 459 bp, Homo sapiens
  misc_feature 2, 37: n = A,T,C or G
anagacacgggccacagtctgatgagtcagtgcaggnagcagggcgagaaggaacagagccaatgatgtgtgggttacactgaggagccaaggacagggcctcaggtctcccccttacaaggcgtggctcatggcctgcattccagagaccaacatgatagcttttaattcagctgcatgacctgtgccttttaagccataaagatacctcaagcctagcacctcttgaaatccagatgttcatattagactcgaaaaaataggctccaggcctaggtgcccaggctatgatgagtctgtttttgaaggaggtagggaatgacatcttccttggacccaaagcttaaaagtaatgtatgctttgctgaccactgtttgttaggccttaaacaacattcactgtggtggtatcaggcacactgctatgtgcatcaattatttttttgctttccaaacaga

SEQ ID NO: 56950 - DNA, 432 bp, Homo sapiens
  misc_feature 6, 34, 58, 362, 364: n = A,T,C or G
agagantgccctttttgaagaaactccacgaagnaggaaatccaggagctgccggctnaaattcaggaacagcatgtccaaatcgatgtggatgtttccaagcctgacctcacggctgccctgcgtgacgtacgtcagcaatatgaaagtgtggctgccaagaacctgcaggaggcagaagaatggtacaaatccaagtttgctgacctctctgaggctgccaaccggaacaatgacgccctgcgccaggcaaagcaggagtccactgagtaccggagacaggtgcagtccctcacctgtgaagtggatgcccttaaaggaaccaatgagtccctggaaacgccagatgcgtgaaatggaananaactttgccgttgaagctgctaactaccaagacactattggccgcctgcaggatgagattcagaatat

SEQ ID NO: 56951 - DNA, 379 bp, Homo sapiens
  misc_feature 82: n = A,T,C or G
agggtcagccatttttaatgatctcggagaccaaaccagccttcggagcgttctctgtcctacttctgactttacttgtggngtgaccatgttcattataatctcaaaggagaaaaaaaaccttgtaaaaaaagcaaaaatgacaacagaaaaacaatcttattccgagcattccagtaacttttttgtgtatgtacttagctgtactataagtagttggtttgtatgagatggttaaaaaggccaaagataaaaggtttctttttttttccttttttgtctatgaagttgctgtttattttttttggcctgtttgatgtatgtgtgaaacaatgttgtccaacaataaacaggaattttattttgctggagttgttct

SEQ ID NO: 56952 - DNA, 204 bp, Homo sapiens
  misc_feature 7, 8, 146: n = A,T,C or G
attcggnnttatggccggccttctagtttgtgctaaacacactgctttatttttacagcccacgtctttcatgaggatacgaattgttaagaggcagtctcgttttgcttttcaaagacattttgtaggagatttttcactaatgngaatctgattttatctacttgattctgtatagattaagtaaatatgtatgataaactt

SEQ ID NO: 56953 - DNA, 232 bp, Homo sapiens
  misc_feature 21, 27, 35: n = A,T,C or G
accggggagaataactgtagnaaaagnaagacagnaagatccaaacaaactgaattagaaatgaaatgagagatatcacaactgataccacagaaataaaagatcatttaaggctattatgaacatcttatgtgcacaaactagaaaatctagagatgtataaattcttggaaatatacaaccctcctagattaaatctggaaaaaatagaaactctgaacaaatcaataac

SEQ ID NO: 56954 - DNA, 473 bp, Homo sapiens
gtaataattgcattttagtgaattgtacagtgggtggaaagggcatttggagctcattagaatgagacatagtacaccccaatggccctgtttattaaatgtagtggattaagtgtctgtcaacaaatacaccaaaaccattttttatagaaacagtatttaatggtcactcaatagctttcaaaatacatttttgtattacagcactgcacaagctattctaatagtgctctcgcctcatcattcctgcaaagcttgctttggggagttggataatgtgaaaattttaagtacctaggggagaaagagccatgtaaatatctgtaataaacttgtagcatatgtaaagttttcttggcctttatcttacaaaaatggagtattttagtatgaatttgctgaatgtaagaccgtggactgttttttataatatggcctaattttaaaggtccaaaataacttgtttttaaagt

SEQ ID NO: 56955 - DNA, 110 bp, Homo sapiens
  misc_feature 7: n = A,T,C or G
accgggnaacttgtatttgtatttagtaggcttctatattgcatttaacttgtttttgtaactcctgattcttccttttcggatactattgatgaataaagaaattaaag

SEQ ID NO: 56956 - DNA, 404 bp, Homo sapiens
  misc_feature 9, 15: n = A,T,C or G
gaccggggnaaaagnacccgagccttgtatgtatgttatggatacataaaatgcacgcaagccattatctctccatgggaagctaagttataaaaataggtgcttggtgtacaaaactttttatatcaaaaggctttgcacatttctatatgagtgggtttactggtaaattatgttattttttacaactaattttgtactctcagaatgtttgtcatatgcttcttgcaatgcatattttttaatctcaagcgtttcaataaaaccatttttcagatataaagagaattacttcaaattgagtaattcagaaaaactcaagatttaagttaaaaagtggtttggacttgggaacaggactttatacctcttttactgtaacaagtactcattaaaggaaattg

SEQ ID NO: 56957 - DNA, 498 bp, Homo sapiens
  misc_feature 8, 13, 28: n = A,T,C or G
accggagnaagtnacactagtatatatnatttaatacatttacactttcttatttaagaagatattgaatgcaaaataattgacatatagaactttacaaacatatgtccaaggactctaaattgagactcttccacatgtacaatctcatcatcctgaagcctataatgaagaaaaagatctagaaactgagttgtggagctgactctaatcaaatgtgatgattggaattagaccatttggcctttgaactttcataggaaaaatgacccaacatttcttagcatgagctacctcatctctagaagctgggatggacttactattcttgtttatattttagatactgaaaagtgctatgcttctgttattattccaagactggagataggcagggctaaaaaggtattattatttttcctttaatgatggtgctaaaattcttcctataaaattccttaaaaataaagatggtttaatcactaccattgtgaaaac

SEQ ID NO: 56958 - DNA, 368 bp, Homo sapiens
  misc_feature 3, 82, 143, 284, 307, 308, 361: n = A,T,C or G
gantgcgataggaatcatgtctggtcgcggcaaaggcggaaaaggcttggggaagggtggtgctaagccgccatcgtaaggngctccgggataacatccagggcattacaaaaccggctattcgccgtttggctcggcgcggnggggtcaagcgcttttccggtcttatctatgaggagactcgaggtgtgcttaaggttttcttagagaacgttattcgagacgccgtcccctatacggagcccgccaagcgcaaaaactgtcacagccatggatgtagtatntgccctaaaacgtcagggggccnncctctgtattggcttcggcggcttgaatctaaaaataccccggcctccttganaactttc

SEQ ID NO: 56959 - DNA, 127 bp, Homo sapiens
ataggaagtatcgcaattgttttgttttcatttcttgtagtctaacccttttaatgcctttacctcaagttgcttggcagcacaactatctttgcaaaaaaagtaaagaaaaagtaaatgatggttt

SEQ ID NO: 56960 - DNA, 274 bp, Homo sapiens
  misc_feature 9: n = A,T,C or G
ggtaccagnatcctgaggaaaattacgggcagaaggaggctgagaaagtggcccgggtgaaggcgctatatgaggagctggatctgccagcagtgttcttgcaatatgaggaagacagttacagccacattatggctctcattgaacagtacgcagcacccctgcccccagccgtctttctggggcttgcgcgcaaaatctacaagcggagaaagtgacctagagattgcaagggcggggagaggaggctctcaataaataatcgtgtaacctt

SEQ ID NO: 56961 - DNA, 407 bp, Homo sapiens
  misc_feature 13, 344: n = A,T,C or G
atacattaaaganataagggggaaaatagaggatctctgatctttataagctctgtttagtaaggaagatgtgtaagtaaaagattgcaattcaatgttatcagtgtgataacgggaacaaaaaaagaggccagacgcagtggctcatgcctgtattcccagcacttcgggggcggaggcgggcggatcacctgaggtcaggagttcgggaccggcctgaccaatatggtgaagccccgtctctactaaaaatacaaaaattggctgggcgtggtggcgcgtgcctgtagtcccagctactcggggggctgagacaggagaattgcttgagtccgggaggtggnaggttgcagtgagccgagatcatgccactgcacactccagcctggacgacagagcgagtccat

SEQ ID NO: 56962 - DNA, 464 bp, Homo sapiens
  misc_feature 89: n = A,T,C or G
gattgcagataatttttagcttagggcctggtggctaggtcggttctctcctttccaggcggagacctctgccgcaaacatgctccgcnagatcatcggtcaggccaagaagcatccgagcttgatccccctctttgtatttattggaaccggagctacctggagcaacactgtatctcttgcgtctggcattgttcaatccagatgtttgttgggacagaaataacccagagccctggaacaaactgggtcccaatgatcaatacaagttctactcagtgaatgtggattacagcaagctgaagaaggaacgtccagatttctaaatgaaatgtttcactataacgctgctttagaatgaaggtcttccagaagccacatccgcacaattttccacttaaccagggaaatatttctcctctaaatgcatgaaatcatgttgggagatctctattgtaatctct

SEQ ID NO: 56963 - DNA, 435 bp, Homo sapiens
  misc_feature 56, 144, 406, 410: n = A,T,C or G
gctaaatagctagcttaacctcaagatcaacttaaaaacatcaataacctataatnaacctaaaaccacaaactaaaccattatattatcctagtatgggagacagaaaagataaaatactaagcaatagagaaagtaccgcangggaacgctgaaagagaaatgaaataacccgtaaaagcaataaaaagcaaagattaaaccttgtaccttttgcatcatgatttagccaacaccactaagcaaagagacctttagtttaaagccccgaatccaggtgagctaccccggagacagcctatttaacttagggccaacccgtctctgtggcaatagagtggggaagagctccgggtaggaagtgacagacctatcgaacctggcaatagctggttgtctgggagangaanaaaagttcagctttcgtacaccccc

SEQ ID NO: 56964 - DNA, 458 bp, Homo sapiens
atggaccgggggacaactcggtggtggccactgcgcagaccagacttcgctcgtactcgtgcgcctcgctttgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggcagggaaggaaagaacttgcatgttggtgaaggaaga

SEQ ID NO: 56965 - DNA, 197 bp, Homo sapiens
  misc_feature 34: n = A,T,C or G
cagggggaaatgatttgcatcatgttcttttttnataatgcttttacttcctgtttggatcagttgtatgtaaatgtacatttttgttactttggctgtgcccgttagaatttatcttccataaagtatttctcccattgagtctaatgatgtatactttacctaggtctttccaaaattaaatttatgtaaatgtc

SEQ ID NO: 56966 - DNA, 500 bp, Homo sapiens
  misc_feature 2, 3: n = A,T,C or G
annggaccggggtgaggaggcgtttaagaatagaatggaggttaaagtgaagattcctgaagaattaaaaccatggcttgttgaggactgggacttagttaccaggcagaagcagctgtttcaactccctgccaagaaaaatgtagatgcaattctggaggagtatgcaaattgcaagaaatcgcagggaaatgttgataataaggaatatgcggttaatgaagttgtggcaggaataaaagaatatttcaatgtgatgttgggcactcagctgctctacaaatttgagaggccccagtatgctgaaatcctcttggctcaccctgatgctccaatgtcccaggtttatggagcaccacacctactgagattatttgtaagaattggagcaatgttggcctatacgccccttgatgagaaaagccttgcattattgttgggctatttgcatgatttcctaaaatatctggcaaagaattctgcatctctctttactgcca

SEQ ID NO: 56967 - DNA, 497 bp, Homo sapiens
  misc_feature 11, 13, 45: n = A,T,C or G
tgagttgcggncnttatggaccgggaagcaacagccgacgcaagnatggcagccaccacgggctcgggagtaaaagtccctcgcaatttccgactgttggaagaactcgaagaaggccagaaaggagtaggagatggcacagttagctggggtctagaagatgacgaagacatgacacttacaagatggacagggatgataattgggcctccaagaacaatttatgaaaaccgaatatacagccttaaaatagaatgtggacctaaatacccagaagcacccccctttgtaagatttgtaacaaaaattaatatgaatggagtaaatagttctaatggagtggtggacccaagagccatatcagtgctagcaaaatggcagaattcatatagcatcaaagttgtcctgcaagagcttcggcgcctaatgatgtctaaagaaaatatgaaactccctcagccgcccgaaggacagtgttacagcaattaatcaaaaag

SEQ ID NO: 56968 - DNA, 498 bp, Homo sapiens
gtggccgggattgctagtttgtatttctaacttctacagttatagactccactgtgctttgtgtctgaatttctcagtatagacattttgtttactgtatgcttgcatatttattttcaactttgtttgtctttaaaattgcttgaggaaaaatggttgtaattaatttctgctacagaaaagccacctggtacgttttgtctcatcaggattgttttaaattctaaactataagtttgttcagaggggcttttgcaatgatagcagaaaactgtacaaatgtacagttagttatagaggttcttgttgaaatgaacttaccatctgatgatatgtatgtacagctgtgtacttgagtcttttttagtttacttagaaagactagcagtttgacctgttaaacaggactagttcaagtcaagaaactaaggttgttgtatacacctggaggcatctgttattcagcttatcctttgagtgggtatttggcacaatgag

SEQ ID NO: 56969 - DNA, 500 bp, Homo sapiens
  misc_feature 4, 11: n = A,T,C or G
aagnaacaagncgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgtttggttttactaaaaaacgcaacaatcagatacggaagacctcttatgctcagcaccaacaggtccgccaaatccggaagaagatgatgga

SEQ ID NO: 56970 - DNA, 437 bp, Homo sapiens
  misc_feature 338: n = A,T,C or G
accgggcatgaaaagaaacttgtgcttcaccgaagaaaaatatctaaacatcgaaaaacttaaatattatgaaaaaaaaacattgcaaaatataaaataaataaaaaaaggaaaggaaactttgaaccttatgtaccgagcaaatgccaggtctagcaaacataatgctagtcctagattacttattgatttaaaaacaaaaaaacacaaaaaaatagtaaaatataaaaacaaattaatgttttatagaccctgggaaaaagaattttcagcaaagtacaaaaatttaaagcattcctttctttaattttgtaattctttactgtggaatagctcanaatgtcagttctgttttaagtaacagaattgataactgagcaaggaaacgtaatttggattataaaaattcttgctttaataaaaattccttaaacaga

SEQ ID NO: 56971 - DNA, 117 bp, Homo sapiens
  misc_feature 17: n = A,T,C or G
gggtagaatcttagttnaactttaaatttgcccacagaaccctctaaatccccttgtaaatttaactgttagtccaaagaggaacagctctttggacactaggaaaaaaccttgtgg

SEQ ID NO: 56972 - DNA, 498 bp, Homo sapiens
gtggccggggagagaggctgttcgcagaagctgcggaagatgaatgccagaggacttggatctgagctaaaggacagtattccagttactgaactttcagcaagtggaccttttgaaagtcatgatcttcttcggaaaggtttttcttgtgtgaaaaatgaacttttgcctagtcatccccttgaattatcagaaaaaaatttccagctcaaccaagataaaatgaatttttccacactgagaaacattcagggtctatttgctccgctaaaattacagatggaattcaaggcagtgcagcaggttcagcgtcttccatttctttcaagctcaaatctttcactggatgttttgaggggtaatgatgagactattggatttgaggatattcttaatgatccatcacaaagcgaagtcatgggagagccacacttgatggtggaatataaacttggtttactgtaatagtgtgctgttcatggaaaccgagggctgcat

SEQ ID NO: 56973 - DNA, 496 bp, Homo sapiens
  misc_feature 1, 40, 67: n = A,T,C or G
naattccggccattatggcccgggggttgatcgtgagccnagttctccaagaatcagtgcacacagnacccagagccctgtcaccggaaatcaggacttgagaagatgggtgcgtttgtgcatatttggagggtagagttatttttgtacatgtgtgtgcctgtgtgtgtgtatgcatatatgtgtgagtgtgtatgtgtatgcatgtgtgtgccgtttgtctgattaaacttgctgtggaaccttggcaaacacatatgtgacctgacctgaacaaactgttgtcccttgttcaaacggtcatttcattttcacaaggtaaaggattgcttacatttgctgatgtttattatataatatgaagtacagtataacaaaaatattaatctaccaacagtataattttctaagaaagaaaaccaggttaccggtgtgtaaaatcgggtctgtggtaaaccgcataggactgtacatctttcctgttttggaaggagtc

SEQ ID NO: 56974 - DNA, 500 bp, Homo sapiens
  misc_feature 3, 6: n = A,T,C or G
aanagnaccggggtagacaaaacagccttctattgggaaaagatgccgtctggaacttacatagctacagagaagtcaatgcctggcttcaaagcttcaaaagacaggctgactcttgttaggggctaatgcagctggtgacttgaagttgaagccattgctcatttaccattctaaaaatcctagggcccttcagaattatgctagatctactctacttgtgctctataaatgtagctaccaagcctgtatgacaggacgtctattagcagcatggtttactgaatatttgaagccaactgttgaggcctgctgcttagaagaatatttatttcagaatatcactgctcttcagccatgcacctagtcacccaagagcgcttatgtaaatctacaaggagatgtatgttgttttcatgcctgttaactcagcattcattctgcaaccaatgactcaaggagtaattttgacttttgagtcttattatttaagaaatata

SEQ ID NO: 56975 - DNA, 499 bp, Homo sapiens
  misc_feature 2: n = A,T,C or G
gnggccgggggtcgacgtgtgcagaagtcctggtaatctggtccttgttcccgtctggataccagcttccttcagcagcgcaggcggtggtccctgaggcccgtggaaggagtcaaacttgcgggaattttgcagtttatctgcagggctgttgtttccagcaagacccaaagctagaaaaggaggaggaagaaactgacccgatcagtgccagaagtcattgtattcaaagaagaataagcaagaaagaaaagaaggaaggaagagaggtagacagatacaagatgaaatcctgtcaaaaaatggaaggaaaaccagaaaatgagagtgaaccaaagcatgaggaagagccaaagcctgaggaaaagccagaagaggaggagaagctagaggaggaggccaaagcaaaaggaacttttagagaaaggctgattcaatctctccaggagtttaaagaagatatacacaacaggcatttaagcaatgaagatatgtttag

SEQ ID NO: 56976 - DNA, 489 bp, Homo sapiens
attgtttttactgtcatttttttccaatagtttgttttactttttaaatatttttatctcaatgttattttagtaaatagtactatgttatggaagtctattttatgcactgctcattctctatagagttccttattgcgagactaataaagaagaaaagagagaagaatcaaatagatgcaataaaaaatgataaaggggatatcaccaccgatcccacagaaatacaaactaccatcagagaatactataaacacctctacgcaaataaactagaaaatctagaagaaatggataaattcctcgacacatacaccctcccaagactaaaccaggaagaagttggatctctgaatagaccaataacagactctgaaattgaggcaataattaatagcttaccaaccaaaaaaagcccaggactagacggattcacagccgaattgtaccagaggtacaaggaggagctggtaccattccttctgaaac

SEQ ID NO: 56977 - DNA, 496 bp, Homo sapiens
  misc_feature 472: n = A,T,C or G
accgggggaaatttctgagagagtgtagttaatttagtaattctgtttcatgagatatgatctgttatgctagtggtttaataggcttgctatgtaagtagaacgtggctcaactagatatctttatatgtatgggcattactcttagtgatatttgtttcctgtcctttgttgctcatgctgtttaagtgcgggctgagacccagcctctttgtaagtacagtaaaataatccaccgttttttacagaccctagtcaaagggttaaaaaaattaagattgctttccatgtttgaaatttaccattgagagtcaatgaagttgctattttgagtttagcattgatattgtgaaaataagtgcaatttggatttcatgtttcttaatattcattcttgtttcacaaatgaatgattaaggaattatgcatcataaaggaacctaagtgaggtatatgaatgaggggtatttgncctttgcacacacatataggtata

SEQ ID NO: 56978 - DNA, 376 bp, Homo sapiens
  misc_feature 3, 4, 362, 371, 372: n = A,T,C or G
acnngcggccattgtggccgggatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccagcctgctccacccagagaagcacactttgtgagaaccaatgggaaggagcctgagctgctggaacctattccctatgaattcatggcataataggtgttaaaaaaaaaataaaggacctntgggctccnnagga

SEQ ID NO: 56979 - DNA, 500 bp, Homo sapiens
  misc_feature 3, 5: n = A,T,C or G
ccnantacaactcggaaactataagtaattctcaaggaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgcctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaatttccaggaaaaaataaaaagagtatgagtcttctgtaattcattgagcagttagctcatttgagataaagtcaaatgccaaacactagctctgtattaatccccatcattactggtaaagcctcatttgaatgtgtgaattcaatacaggctat

SEQ ID NO: 56980 - DNA, 155 bp, Homo sapiens
cgaggaaggagtacgagcaggagctcagtgatgacttgcatgtggagcgctaccgacagttctggaccaggaccaagaagtgaccgtggctccagccaccccgggacattgctaagatgggagggctgttcttaaatcactcgttcttgaagctg

SEQ ID NO: 56981 - DNA, 496 bp, Homo sapiens
  misc_feature 179, 186, 213, 216, 235, 259, 343, 382, 473, 484: n = A,T,C or G
accggggttttatatatgaattatagtattttaggaagacaggaactttttttttcccctaagagatgtttcaaccaagaaaatcaatttttttccaactgcttcttcattttctcatatttcatgctggttttctttacaagatttttttttaatgctcatgaaactatgaccttgtntaagttncccaggagacatgattctcagcatttngtnggacaaacatttgtttttngtaactacttgaacaagccaaatngcacgtagtccaaaaaataattctggcctttttaactacactctttttctttttaatgccatattcaaggaatcccagtacagnggcaattaaaacacgcgaattttgccatttaaccatganaaggatttacagccttggcacatatagtaagataagttaacactctgaggaaggtttcacagtatattctcattttaattgtcagttgagnggacatgaaanaaggcattttct

SEQ ID NO: 56982 - DNA, 255 bp, Homo sapiens
  misc_feature 14, 16, 255: n = A,T,C or G
accggggaaaaagnanctttggacttccacgggccatggactggggagaggtataagccgatataaatccatcttttggggaagaagagacgaggacacagatacacaaagagaacccatctgaagacacagggagaagatggccatctacaagtgaagaagagagaccccagaagaaaggaaccatgtaaacaccttgatcttggacttgtagcctccagaactgtgagaaataaatttctactgtttaagctn

SEQ ID NO: 56983 - DNA, 347 bp, Homo sapiens
  misc_feature 3, 7: n = A,T,C or G
acnaagncgtaccatccagtttgtggattggtgccccactggcttcaaggttggcatcaactaccagcctcccactgtggtgcctggtggagacctggccaaggtacagagagctgtgtgcatgctgagcaacaccacagccattgctgaggcctgggctcgcctggaccacaagtttgacctgatgtatgccaaacgtgcctttgttcactggtacgttggggaggggatggaggaaggtgagttttcagaggcccgtgaggacatggctgcccttgagaaggattatgaggaggttggtgtggattctgttgaaggagagggtgaggaagaaggagaggaatact

SEQ ID NO: 56984 - DNA, 465 bp, Homo sapiens
  misc_feature 19: n = A,T,C or G
gagcagtttgaaatcaagnacatagcttttctcattcaccctcccacttggggctaatgcacagacatgaacatctattgaggaaaaccacaaaaaacttcaaaacagctacaacgggaaaaagagagttttgtcccacagtcagcaggccactagtttattaacttccagtcaccttgatttttgctaaaatgaagactctgcagtctacacttctcctgttactgcttgtgcctctgataaagccagcaccaccaacccagcaggactcacgcattatctatgattatggaacagataattttgaagaatccatatttagccaagattatgaggataaatacctggatggaaaaaatattaaggaaaaagaaactgtgataatacccaatgagaaaagtcttcaattacaaaaagatgaggcaataacaccattacctcccaagaaagaaaatgatgaaatgc

SEQ ID NO: 56985 - DNA, 372 bp, Homo sapiens
  misc_feature 51: n = A,T,C or G
attgccggcgtcttggcgattcggcccgacgagctccgttttcgctacagntggtggcctactggagacaggctggactcagctacatccgatactcccagatctgtgcaaaagcagtgagagatgcactgaagacagaattcaaagcaaatgctgagaagacttctggcagcaacgtaaaaattgtgaaagtaaagaaggaataatctaccctgactaaagcttgaaatgctacatttccaaggtgaagatgtgtgggcacatgttatggcagattgaaaaggatctcattccatgggaaaaaaaaaaatcctgtcttgttcataaattgacaatgtcaataaattgaaatatggttcactgttactcttg

SEQ ID NO: 56986 - DNA, 188 bp, Homo sapiens
  misc_feature 188: n = A,T,C or G
atggcgaaaccccatttctactaaaaatacaaaaaattagctgggcgtagtggcatgtgcctgtattcccagctactcaggaagctgaggcaggagaatctcttgaacctgggaggcagaggttgaagtgagtcgagattgtgccattgccctccagcctgggggacaagagcaagacttcgtctcgn

SEQ ID NO: 56987 - DNA, 216 bp, Homo sapiens
atccatggattgatgtctcaggttattaaggataaactgtttaatcaaattaacatctcttaaacagtctctgagaagtactttacctgaaagacagtatgagaaaaatattcaagtaacactttaaaaccagttacccaaaatctgattagaagtataaggtgctctgaagtgtcctaaatattaatatcctgtaataaagctctttaaaatgcc

SEQ ID NO: 56988 - DNA, 299 bp, Homo sapiens
  misc_feature 17: n = A,T,C or G
aatgccctcattaaagncgccggtgtaaatgttgagcctttttggcctggcttgtttgcaaaggccctggccaacgtcaacattgggagcctcatctgcaatgtaggggccggtggacctgctccagcagctggtgctgcaccagcaggaggtcctgccccctccactgctgctgctccagctgaggagaagaaagtggaagcaaagaaagaagaatccgaggagtctgatgatgacatgggctttggtctttttgactaaacctcttttataacatgttcaataaaaagctgaacttt

SEQ ID NO: 56989 - DNA, 448 bp, Homo sapiens
  misc_feature 442: n = A,T,C or G
ggggaagttgaattttttataggttaaatgtcattttagagatggggagagggattatactgcaggcagcttcagccatgttgtgaaactgataaaagcaacttagcaaggcttcttttcattattttttatgtttcacttataaagtcttaggtaactagtaggatagaaacactgtgtcccgagagtaaggagagaagctactattgattagagcctaacccaggttaactgcaagaagaggcgggatactttcagctttccatgtaactgtatgcataaagccaatgtagtccagtttctaagatcatgttccaagctaactgaatcccacttcaatacacactcatgaactcctgatggaacaataacaggcccaagcctgtggtattgatgtgcacacttgctagactcagaaaaaatactactctcataaatgggnggggag

SEQ ID NO: 56990 - DNA, 386 bp, Homo sapiens
agagttaaataattggagggtctctctgcccctagtttcccttccagatttgctaacctaaagccatggaatttgccacaggccacctcaagaggtgagtaggccgggtgcggtggcccatgcctgtaatcccagcactttgggaggccgaggcagatggatcacatgaggtcagaaattggagaccagcctggccaacatggcgaaaccctgtctctactaaaaacacaaaaattagcagggcatggtggtgtgcgcctgtggtcccggctgctcaggaggctgaagcatgagatttgcttgaactccagaggcagaggttgcagtgagctgagatcacgccactgcactcaagcctgggtgacagagcgagactctgtctcaga

SEQ ID NO: 56991 - DNA, 490 bp, Homo sapiens
ggcctgcgacccccgtaaattgcctcggtgatgtcgtgggttcaagcagcctccttgatccagggccctggagacaaaggggacgtgtttgacgaagaagcagacgagtcgctcctggcgcagcgggaatggcagagtaacatgcaaagacgagtcaaagaaggttatagagatggaatagatgctggcaaagcagttactcttcaacagggcttcaatcaaggttataagaaaggtgcagaagtcattttaaactatggacgactccgaggaacattgagtgctttgctctcctggtgtcaccttcataataataattcaactttgatcaataaaataaacaatcttctggatgcagttggccagtgtgaagagtatgtgctcaaacatctgaaatcaatcactccaccgtcccatgttgtagatttattggactccattgaggatatggacctttgtcatgtagttccagctgagaaaaagattgatg

SEQ ID NO: 56992 - DNA, 235 bp, Homo sapiens
  misc_feature 19, 235: n = A,T,C or G
ataaaagaagggggccagnaagtactttaaaacaggtaccaaagggtcattcctttagcatcattcatctttggtttcttcaagttgccactgaaaagctagacctttgcctattatctgctaatctacccagtctcacattctattgactcattgttcaaagggggggcaggaggagctaatttcctttgcacatttgtattttatttcaaaataaagtattctcttctagccn

SEQ ID NO: 56993 - DNA, 465 bp, Homo sapiens
gtctaatctaaatgcctttcaatcagaaaaccgcctcaactgtcaaaatggtaaaaacagttatgtgtgttttcaaagccagaagtgcaatcatgtggtgagacttcagggttttactgttgtccacagttctgagtcccaggactggtttccttactcggtattctcccatggaaaacttcatcggggaattatagggtaatattttcaagacttggaatatgtctacagttacctttctaaaaaacaaacaaaaaaatccatttaaaagcatttttttaaaaataatcatgccagggtagccaaatagaagcaactttggggtttttgcagagtcaagtcttataaattgtggaatattccccttggtccaggagatcatttgactcccacacaccaccacttcctatatccacaaattccagtatgtttggaccctcctgatggctgagagaatcacaaaaa

SEQ ID NO: 56994 - DNA, 317 bp, Homo sapiens
  misc_feature 5, 7, 121, 124, 127, 237, 292, 316: n = A,T,C or G
ccccntntggaccggggaggcattgaggcagcccagcgcaggggcttctgctgagggggcaggcggagcttgaggaaaccgcagaataagtttttttctctttgaaagatagagattaatncanctncttaaaaaatatagtcaataggttactaagatattgcttagcgttaagtttttaacgtaattttaatagcttaagattttaagagaaaatatgaagacttagaagagtancatgaggaaggaaaagataaaaggtttctaaaacatgacggaggttgagatgaancttcttcatggagtaaaaaatgtnt

SEQ ID NO: 56995 - DNA, 418 bp, Homo sapiens
  misc_feature 13, 14: n = A,T,C or G
gaccgggaaggcnnttgaggcagcccagcgcaggggcttttgctgagggggcaggcggagcttgaggaaaccgcagataagtttttttctctttgaaaggtagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttaggttt

SEQ ID NO: 56996 - DNA, 474 bp, Homo sapiens
  misc_feature 41, 113, 116, 119, 284, 445: n = A,T,C or G
ataaaccggaaaggccttgaggcagccagcgcaggggcttntgctgagggggcaggcggagcttgaggaaaccgcagataagtttttttctctttgaaagatagagattaatncanctncttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaancttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataattngaaggcgatcttttaaaaagagattaaac

SEQ ID NO: 56997 - DNA, 252 bp, Homo sapiens
  misc_feature 195, 202, 217, 231: n = A,T,C or G
gcaggatgagaagagaaaaagcaaacagaaattgggggcgtttttgtggatgcaaagaaatttacaggaccccttctaccctagaggtccaagggaattcaggggtggctgcagggccccacgaagggacattgaagacattccttatgtgtagtgtccctggcaggcatttaccaggccatgtgctgggaacgngacgggnatactggagctgtangcatgcctactggngctagcaggctggggacctgt

SEQ ID NO: 56998 - DNA, 346 bp, Homo sapiens
  misc_feature 319: n = A,T,C or G
tataccgtgaatctaagaagatcgatcgccacatgtatcacagcctgtacctgaaggtgaaggggaatgtgttcaaaaacaagcggattctcatggaacacatccacaagctgaaggcagacaaggcccgcaagaagctcctggctgaccaggctgaggcccgcaggtctaagaccaaggaagcacgcaagcgccgtgaagagcgcctccaggccaagaaggaggagatcatcaagactttatccaaggaggaagagaccaagaaataaaacctgccactttgtctgtacatactggcctgtgggattacatagatganggcgtgaaaataaaacaagggctgaat

SEQ ID NO: 56999 - DNA, 234 bp, Homo sapiens
  misc_feature 15: n = A,T,C or G
agaagtgaagaaagnaacaaacttgttttttgtgttttttaaaggaatataaaataatgaaggatgtataattgatgccaaataagcttgttctttagtcacaccgacgtcttatttttccctttaggccagttctgtttttaaggtgtacatggacaatgttacagtgtaagaaactccatatccatatgttcccattcgcattttgtattggttcatgtataccatttttac

SEQ ID NO: 57000 - DNA, 486 bp, Homo sapiens
  misc_feature 2, 9, 26: n = A,T,C or G
ancactttnaaactctttataatgcntcaatcaccctgacatcaaagccagacagacacactacaataaaaagagaaaactacagtccaataaagctgacgaacatagatgcaaaaatcctcagtaaaatactagcaaactgaagtcaacatcacattaaaaagatcattcactatgatcaaatggtattcatcccagggaagcaagtgtatttcaacatacataaataaataaatgtgatacatcatgttaacagaatgacagaaaaaacatattcttttgatatagaaaaagcatttgagaaaattcaacattttatgataatagctcaacaaattaggtatacaaggaatttatctcaacacaacacagaccatatttgacgagcccacaactaacatcatacacaatggggaaaaagtgaaagcttttgctctaagatttgcaacaagacaagagtgccagtgtcaccactttttatcgtta

SEQ ID NO: 57001 - DNA, 261 bp, Homo sapiens
  misc_feature 16, 258, 259, 260: n = A,T,C or G
gcctttaaaaatattnactttagttctctgtgaagaagaggagaaaagcaatcctcctgattgtattgttttaaactttaagaatttatcaaaatgccggtacttaggacctaaatttatctatgtctgtcatacgctaaaatgatattggtctttgaatttggtatacatttattctgttcactatcacaaaatcatctatatttataggaggaatagaagtttatatatatataataccatatttttaatttcccnnnt

SEQ ID NO: 57002 - DNA, 382 bp, Homo sapiens
aatggaaactggggaaacatgcataagtgccaatcctttgaatgttccacggaaacactggtggacagattctagtgctgagaagaaacacgtttggtttggagagtccatggatggtggttttcaagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcaccgaaacacactg

SEQ ID NO: 57003 - DNA, 337 bp, Homo sapiens
  misc_feature 10: n = A,T,C or G
taggaaagtncccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattcca

SEQ ID NO: 57004 - DNA, 154 bp, Homo sapiens
  misc_feature 2, 39: n = A,T,C or G
anaccgggtatgtccaccttcctgggggccttggctttnatctacaatgaagccctcaagggctgaaaataaatagggaagatggagacaccctctgggggtcctctctgagtcaaatccagtggtgggtaattgtacaataaattttttttgg

SEQ ID NO: 57005 - DNA, 415 bp, Homo sapiens
  misc_feature 5, 32: n = A,T,C or G
aaganaatgctgatgccataactttatgtgtngatacttgtcaaatcagttactgttcaggggatccttctgtttctcacggggtgaaacatgtctttagttcctcatgttaacacgaagccagagcccacatgaactgttggatgtcttccttagaaagggtaggcatggaaaattccacgaggctcattctcagtatctcattaactcattgaaagattccagttgtatttgtcacctggggtgacaagaccagacaggctttcccaggcctgggtatccagggaggctctgcagccctgctgaagggccctaactagagttctagagtttctgattctgtttctcagtagtccttttagaggcttgccatacttggtctgcttcaaggaggtcgaccttctaatgtatgaag

SEQ ID NO: 57006 - DNA, 364 bp, Homo sapiens
accggggataaagggagagagcaagcagcgagtcttgaagctctgtttggtgctttggatccatttccatcggtccttacagccgctcgtcagactccagcagccaagatggtgaagcagatcgagagcaagactgcttttcaggaagccttggacgctgcaggtgataaacttgtagtagttgacttctcagccacgtggtgtgggccttgcaaaatgatcaagcctttctttcattccctctctgaaaagtattccaacgtgatattccttgaagtagatgtggatgactgtcaggatgttgcttcagagtgtgaagtcaaatgcatgccaacattccagttttttaagaagggacaaaagg

SEQ ID NO: 57007 - DNA, 235 bp, Homo sapiens
  misc_feature 24: n = A,T,C or G
gctgagggggcaggcggagcttgnggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttga

SEQ ID NO: 57008 - DNA, 109 bp, Homo sapiens
  misc_feature 5, 24, 84: n = A,T,C or G
tcggncttatggaccggggaggcnttgaggcagccagcgcaggggcttctgctgagggggcaggcggagcttgaggaaaccgcngataagtttttttctctttgaaaga

SEQ ID NO: 57009 - DNA, 361 bp, Homo sapiens
  misc_feature 248: n = A,T,C or G
gtaagtagttgacttgccgcacatctctttgtgtacttgtacggtactggcagaaaagtcatttttcaaaagccataggcttttccttgcccttagctgtaataatgcatctgattttgatttcctccagagctgtgtttctgtccatcacctgtgtattggccctgtgtttaccactctggcccactcctcacccccttgctcccctggtcttctggagtttgtgacattgatttgaaatggatggngttctcttgagagcaagtgagattgttagaattaagttccaactatacagttttctaacatagctataaaggtccttgttgctgtttgtgataactgatagataactcattgg

SEQ ID NO: 57010 - DNA, 110 bp, Homo sapiens
  misc_feature 18, 29, 31, 103: n = A,T,C or G
tatggaccggggaatgantttttctgtgnanctaaaagtggtgggtaggggagggagaaccacatacttccctggttaatttatttctaaataaaaatacggnaaatttg

SEQ ID NO: 57011 - DNA, 294 bp, Homo sapiens
gatggcgaactttcttcctagtgtcttaacatttatgaacttatgtttgacttgaggggcatttcagcaaagctgtgaggaaaagtaggttctggactgatgtctgctttgtgccatagacattttggaacataaggaagtatctgcttctactatatgtacaggacttgtccccaaataatttctgaatcccttaatgcagttgagaatcccttaatgcagttgagaacagtaaagttcatgaccataccgaaaagcacttttaagttcacttctttttaaatatttttttag

SEQ ID NO: 57012 - DNA, 144 bp, Homo sapiens
  misc_feature 143, 144: n = A,T,C or G
taatcgtacatttaatttattgctatggtagcacattgtatttgttaatgtacaaaacaaattctaaaaggttgacaaatgtatattttgttgcttaaatgtgtctttgcagaaattgacaataaataacatattttgtgtcnn

SEQ ID NO: 57013 - DNA, 381 bp, Homo sapiens
  misc_feature 8: n = A,T,C or G
gaaggcantgaggcagccagcgcaggggcttctgctgagggggcaggcggagcttgaggaaaccgcagataagtttttttctctttgaaagatagagattaatacaactacttaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaagg

SEQ ID NO: 57014 - DNA, 193 bp, Homo sapiens
  misc_feature 32, 193: n = A,T,C or G
aaggccggcgctgggctcccacgacccctcangtacagatctggccgtcagccgggggccgctgggaactccactcggggaactcctttccaagctgacctcagttttctcacaagaacccagttagctgatgctttattgtaattgtcttaatttgctaagaacaagtaataagtaaatttttaaaaagccn

SEQ ID NO: 57015 - DNA, 279 bp, Homo sapiens
  misc_feature 13: n = A,T,C or G
gaccgggatattnacgtcttaaaataatttaaaacattttaaaatatgaatactgtagtttaaaacaaagaatctaggggaaggaaaagtagacaaagaaatgccaattccagtccaaagctgtatttgccaagttttcttagaatgacttttaccgatttatgaattcttatacacagaatgcataatggaaatactgatttttgtctaaagtggcattattgactgctgctgtgatgctactgtaatgtaatacattattaaattgtttcaaggtgc

SEQ ID NO: 57016 - DNA, 320 bp, Homo sapiens
  misc_feature 33, 239, 245: n = A,T,C or G
aaacaccataatgttttcttttttcttttattncatgatttctaagtatatttttcatgcaggacagtttttcaaccttgatgtacagtgactgtgtaaaatttttctttcagtggcaacctctataatctttaaaatatggtgagcatcttgtctgttttgaaggggatatgacaataaatctatcagatgggaaatcctgttacaaagtagaaaagctttagtaatttactcagtgngggggntttatcctttttttctttttctcccttggtctataatgaaattgttacagcagtgcaaaataaaatcctatgtat

SEQ ID NO: 57017 - DNA, 471 bp, Homo sapiens
  misc_feature 6, 8, 410, 451: n = A,T,C or G
aaaatncnaattagcatgtggttcagaatattcaatgttaggtttttaaaaagtatcttgatggttcttttctatttataatttcagactttcataaagtgtaccaagaatttcataaatttgttttcagtgaactgctttttgctatggtaggtcattaaacacagcacttactcttaaaaatgaaaatttctgatcatctaggatattgacacatttcaatttgcagtgtctttttgactggatatattaacgttcctctgaatggcattgatagatggttcagaagagaaactcaatgaaataaagagaatatttattcatggcgattaattaaattatttgcctaacttaagaaaactactgtgcgtaacctctcagtttgtgcttaactccatttgacatgaggngacagaagagagtctgagtctaccctgtggaatatgttggnttattttcagggcttgaaga

SEQ ID NO: 57018 - DNA, 399 bp, Homo sapiens
  misc_feature 31: n = A,T,C or G
atctctgatggcaactcctatggtgttcctnatgatctgctctactcattccctgttgtaatcaagaataagacctggaagtttgttgaaggtctccctattaatgatttctcacgtgagaagatggatcttactgcaaaggaactgacagaagaaaaagaaagtgcttttgaatttctttcctctgcctgaccagacaatgatgttactaaatgcttcaaagctgaagaatctaaatgtcgtctttgactcaagtaccaaataataataatgctatacttaaattacttgtgaaaaacaacgcattttaaagattacgtgcttcttggtacaggtttgtgaatgacagtttatcgtcatgctgttagtgtgcattctaaataaatatatattcaaatg

SEQ ID NO: 57019 - DNA, 455 bp, Homo sapiens
  misc_feature 18: n = A,T,C or G
tatatggaccgggggttnatgtcctgcatctaacgcggtgtatcccccgagccgagcgagctccggaggaatttcagtatctgctacggtaacttcatcagcccgccaagatgacgatgcaagcggccaagagggcgaacattcgacttccacctgaagtaaatcggatattgtatataagaaatttgccatacaaaatcacagctgaagaaatgtatgatatatttgggaaatatggacctattcgtcaaatcagagtggggaacacacctgaaactagaggaacagcttatgtggtctatgaggacatctttgatgccaagaatgcatgtgatcacctatcgggattcaatgtttgtaacagataccttgtggttttgtactataatgccaacagggcatttcagaagatggacacaaagaagaaggaggaacagttgaagcttctcaaggag

SEQ ID NO: 57020 - DNA, 273 bp, Homo sapiens
  misc_feature 19, 44, 46, 236: n = A,T,C or G
tatggaccgggaaacaacnaaaaatttaactccatatgtgttcntnttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggngctataataaataaacttcaacactctttatgataac

SEQ ID NO: 57021 - DNA, 100 bp, Homo sapiens
  misc_feature 3: n = A,T,C or G
atnttgattcaagaagcttcctccaggcgggagcggctatttttcctaaatgagaattgttacattgcaaattgttgaataaaatattttgcgctccttc

SEQ ID NO: 57022 - DNA, 312 bp, Homo sapiens
cacttttgcctggtaagaatagtgctgctggccaggagcagtggctcctgcctgtaatctcagcaatttgagaggctgaagcaggcggatcacctgaggtcaggagttggcaaccagcctggccaacgtggtgaaactctgtctctactaaaaatacaaaaattagccgggcgtggtggcgcacacctgtaatcccagctactcaagaggctgaggcaggagaatggcttgaacccaggaggtggaggttgcagtaagccaagatgatgccactgcattccagcctgggcaacagagcaaaactccatctcg

SEQ ID NO: 57023 - DNA, 201 bp, Homo sapiens
  misc_feature 33: n = A,T,C or G
gaagaacacgagctgtggggatctggcactgtngttcctgcatgaagacagtggctggcggtgcctggacgtacaataccacttccgctgtcacggtaaagtccgccatcagaagactgaaggagttgaaagaccagtagacgctcctctactctttgagacatcactggcctataataaatgggttaatttatgtaccac

SEQ ID NO: 57024 - DNA, 500 bp, Homo sapiens
gctgactcctactttataggctgagtcaatgagggaagatgactggcgtttcctctgtctaaatgggaggttgccagagcgctggctgggactaggatgtgtaactaagatttcagtttgaaatcttagatttcagttcacggcgataaagaagtaggtgctgcacacaaatatgtaaagcaattgtaggaaatttgaaaggaaaaaaagaaaccgaagccagtattttaataattgctttttctgtgtattttgtattgggctgggggatagcatcaaaggttgaactttttgagctttctatgaaaaaccccaggaccttctttctttggccatttctatggaaatgcgatgtcagatggatggtaatggtgccctccagtggctgtgagacctcattgcgcattgtctactggagctttagtcttctgagacggaggaaaactgctgaatactctggattcatctatgtctacaatgttgcatttatgaaaaactac

SEQ ID NO: 57025 - DNA, 351 bp, Homo sapiens
tgactccgctgctcgccatgtcttctcacaagactttcaggattaagcgattcctggccaagaaacaaaagcaaaatcgtcccattccccagtggattcggatgaaaactggaaataaaatcaggtacaactccaaaaggagacattggagaagaaccaagctgggtctataaggaattgcacatgagatggcacacatatttatgctgtctgaaggtcacgatcatgttaccatatcaagctgaaaatgtcaccactatctggagatttcgacgtgttttcctctctgaatctgttatgaacacgttggttggctggattcagtaataaatatgtaaggcctttcttttt

SEQ ID NO: 57026 - DNA, 265 bp, Homo sapiens
  misc_feature 17, 43, 44: n = A,T,C or G
tataagccggggcacgnccactttgggaggccaaggtgggtgnntcacgaggtcaggagttcgagatcagcctggccaacatggtgaagccctgtctctactaaaaatacaaaaaattggccaggtatggtggtgggcgcctgtagtctcagctgcttgggaggctgaggcaggataatcacttgaacctggagggcggaggttgcagtgagctgagatcgtaccactggactccagcctgggtgacagagcgagactccgtcgc

SEQ ID NO: 57027 - DNA, 464 bp, Homo sapiens
  misc_feature 25: n = A,T,C or G
gacctcttgtgccaagagcatcatnggcgtgataccctactttccttacagcaagcagtgcaagatgagaaaaagaggctccattgtctctaaattgctggcttccatgatgcgcaaagctggtctaactcatcttattactatggatttacaccagaaggaaattcagggcttcttcaatattcctgttgacaatttaagagcatctcccttcttattacagtatattcaagaagagatcccagattacaggaatgcagtaatcgtggccaagtctccagcctcggcgaagagggcacagtcttttgctgagcgcctgcgcctgggaattgcagtgattcatggagaggcgcaggatgccgagtcggacttggtggatggacggcattccccacccatggtcagaagtgtggctgccatccaccccagcctggagatccccatgctgattcctaaagaaaagc

SEQ ID NO: 57028 - DNA, 450 bp, Homo sapiens
  misc_feature 25: n = A,T,C or G
gatatgattaacatcttaatcacanccatagaaaatgacttatttccagaagataccgctctaaaaatgaaattgttaggtgaaagtgtttttgagaatttttatatatattactcactgcagagatcatgttcatttacattcccattagcaatatatccaatgctcagaattgaaaattactacttaaaatctttgcaaattgaataattacagaaaagggctacatttaaaatttgtatttgtttttcttacttagtgaaggttgtgttttttttcatattcattggccatgctatattcattcttttgagaattgctcattcatattttttctgttgcttgcttggagaatttgctctttttttggcatataagttcttaagaatgtccgtcctttgtcatatattgtaactttttttagccttatttgtcatttaacatagtttg

SEQ ID NO: 57029 - DNA, 169 bp, Homo sapiens
gtcgtgagacccatctctacaaaataaaagttaaaaattagctgggcttgttggtgtgcgcctgtagtcccagctactcaggaggatcgcttgagcccgggaggtcgatgctgcagcaagctgtggtagcgccacagcactccagcctgggtgacagtgagaccctgtc

SEQ ID NO: 57030 - DNA, 447 bp, Homo sapiens
  misc_feature 30, 31: n = A,T,C or G
gttaacagggtaacatgggttacctttgcnncagcttcagtgttaagctcaccctgttctttgaagcacccatgtcagtattagaagaataggcagcagttccttagtttacatatgtttgtgcaattattttctgtacttttttgttcattaattttgtcagtattacaccaaactgtttttgcaacaaaaaaattttttttgcattcatttaattttaggtcaaataacattttatttatgtggctcattttatatttcctaattttatttatttcatactgtagtgtacagtattatagttcttcaatatatagatatattttagtaaaaaaggaacatgacgttgatcatttgggcaaattttacgtaaagagaagagcatttattgtgttttggaacattaattgtgagatgggatttttcaattttattattttatttttg

SEQ ID NO: 57031 - DNA, 478 bp, Homo sapiens
  misc_feature 6, 23, 31, 32, 235, 238, 307, 384, 465: n = A,T,C or G
gtagtnctgtaatatttttaatnatcttaanntatgatttgatataatcttattgaaattaccttatcatgtcttagagcccgtctttatgtttaaaactaatttcttaaaataaagccttcagtaaatgttcattaccaacttgataaatgctactcataagagctggtttggggctatagcatatgcttttttttttaattattacctgatttaaaaatctctgtaaaaacgngtngggtttcataaaatctgtaactcgcattttaatgatccgctattataagcttttaatagcatgaaaatngttaggctatataacattgccacttcaactctaaggaatatttttgagatatccctttggaagaccttgcttggaanagcctggacactaacaattctacaccaaattgtctcttcaaatacgtatggactggataactctgagaaacacatctagtntaactgaataagc

SEQ ID NO: 57032 - DNA, 350 bp, Homo sapiens
  misc_feature 18, 21, 32, 327: n = A,T,C or G
gaccggggaagtcactgnaanagggaaaaggnagtgagtattacaaagccgtcaaagccccaacagctttgtatttctccagcccggcgcagaccccggagctcccgaggcactccctccatctttggaacacgccagtaattgattgataacaggaagctatgagggaccctgtgagtagccagtacagttcctttcttttctggaggatgcccatcccagaactggatctgtcggagctggaaggcctgggtctgtcagatacagccacctacaaggtcaaagacagcagcgttggcaaaatgatcgggcaagcaactgcagcanaccaggagaaaaaccctgaaggt

SEQ ID NO: 57033 - DNA, 105 bp, Homo sapiens
  misc_feature 104: n = A,T,C or G
aggtaattaaaataaaatgagaagcctgttagtagaagccttgattcctttgaagtgactattggtagaaatatgaacattaaaatgattttggtgaaggctcng

SEQ ID NO: 57034 - DNA, 343 bp, Homo sapiens
cccggcgaagccacagaaaaccgtccctgctacagagcaggagttgccgcagccccaggctgagacagggtctggaacagaatctgacagtgatgaatcagtaccagagcttgaagaacaggattccacccaggcaaccacacaacaagcccagctggcggcagcagctgaaatcgatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtctacaagagccct

SEQ ID NO: 57035 - DNA, 431 bp, Homo sapiens
  misc_feature 25: n = A,T,C or G
taaatcagaaagacatttttccagnagaagaaattcctcagattccttctgtaggaattcagaggacaagatttgtggttataggagatttgaaaaggatatagagggaagaaaagagcactatagaaggtgggaaccaggttctgtgaggcattctacctcaccagcaagctcagaatactcttggaagtctgttgagaaatacaaaaaatacgctcactctggatcacgtgatttcagtagacatgagcaaagataccgtttaaatacaaatcaaggagaatatgaaagagaggacaattatggggaggatatcaaaacagaggttccagaagaagatgcactaagtagcaaagaacactcagaaagcagtgttaagaaaaatttacctcagaatttactgaatatatttaatcagatagctgaatttg

SEQ ID NO: 57036 - DNA, 486 bp, Homo sapiens
  misc_feature 28: n = A,T,C or G
catctttgtcttgtgtcagttttcaagngaacgcttccaggttttcaggtactcaggcaacaaatagcgttacaatagaatagtacctcacatctcaatgctaatgttgaacgtaaatggcctaaatgctccacttaaaagatatagaatggcagaatgggtaagaattcaccaaccaagttgctgctgtcttcaggagactcacctaacacatacggactcacataaacttaaggcaaagggttggaaaaagacacttcgtctaaatggacacatcaaaagcgagcaggagtagctgttcttatatcagacaaaacggactttaagacaacagcagttttaaaaagacaaagagggacattatataatgataaaaggactagttcaacaggaaaatatcacagtcctaaatatatatgcacctaatactggagatcccaaatttataaaacaattactactagacataagaaatgaggtagttgg

SEQ ID NO: 57037 - DNA, 262 bp, Homo sapiens
  misc_feature 261: n = A,T,C or G
gagatatccctttggaagaccttgcttggaagagcctggacactaacaattctacaccaaattgtctcttcaaatacgtatggactggataactctgagaaacacatctagtataactgaataagcagagcatcaaattaaacagacagaaaccgaaagctctatataaatgctcagagttctttatgtatttcttattggcattcaacatatgtaaaatcagaaaacagggaaattttcattaaaaatattggtttgaant

SEQ ID NO: 57038 - DNA, 473 bp, Homo sapiens
  misc_feature 5, 10, 30: n = A,T,C or G
gagcnaaagnagtgtgtctgattggtcctnggattttttgagctgtgccatttatggtactctttgcctacgcatcccctttttagattttttttaaattttatcttactgtttttataatttctattgggaagaggcttgtgaccagtaccaatcttgagtttctttttctgtccacaagtaaattaatatctgctctgaaatgtcatttatctactcacacattcttggggaaaaaaatcaaatgtcagtcctagcagatgttgcatgtaaattggtagcaagtaatgattacaacccagaggattaagaattttgtaacagaaagctctatgttttaattttttatatacaattaggataattagcattgtcagactataaacctttgctttttaaagtttatttttactatttctttatcactttattgtatcatcaccattggtttcataatgtaaatactatatgtt

SEQ ID NO: 57039 - DNA, 191 bp, Homo sapiens
  misc_feature 181: n = A,T,C or G
tacagtcagcaggccactagtttattaacttccagtcaccttgatttttgctaaaatgaagactctgcagtctacacttctcctgttactgcttgtgcctctgataaagccagcaccaccaacccagcaggactcacgcattatctatgattatggaacagataattttgaagaatccatntttagccaag

SEQ ID NO: 57040 - DNA, 496 bp, Homo sapiens
  misc_feature 19, 21, 41, 47, 201: n = A,T,C or G
ccctttaatattaaagagntnttattgtctgcatttgtggnagctcnttgatatagtgacacagaaaagcgaacttcctgtggtactgagtccctttgcttctgcaaaagaaaaaaaagttgtttcttattttagttttttatttctgaatgttcagaataaatgaggacaaagtgttactcgtatttatgtgagttcagntcgaaagcaaacttgtggttgaattaaagggtccaggatggtttcaagcgaaaaaattcaagatctggtaaatataaacgcttgtttgtacaacttaaagacatatattagtaattacatagctcgattctaatgggcactttctttgggttgaacttgattgctaatcattcacccccttaggaaatatggtaaaaacccaccagcttctaaataaggaagttactgttcccttcttagtatcagaaagttaatcttgtgaacagtgtaggttctctttgatgcagatgctgga

SEQ ID NO: 57041 - DNA, 414 bp, Homo sapiens
  misc_feature 37, 41: n = A,T,C or G
aaccgggggaaacattggtttaaaaagaaaagtgtanttcnagaatttaaagaaatatttttaaagccacaattattttaatattggatatcaactgcttgtaaaggtgctcctcttttttcttgtcattgctggtcaagattactaatatttgggaaggctttaaagacgcatgttatggtgctaatgtactttcacttttaaactctagatcagaattgttgacttgcattcagaacataaatgcacaaaatctgtacatgtctcccatcagaaagattcattggcatgccacaggggattctcctccttcatcctgtaaaggtcaacaataaaaaccaaattatggggctgcttttgtcacacctagcatagagaatgtgttgaaatttaactttgtaagcttgtatgtgg

SEQ ID NO: 57042 - DNA, 487 bp, Homo sapiens
aagtgccaatcctttgaatgttccacggaaacactggtggacagattctagtgctgagaagaaacacgtttggtttggagagtccatggatggtggttttcagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgcttt

SEQ ID NO: 57043 - DNA, 124 bp, Homo sapiens
accggggaattggaagcatttattcaaaatcttaatttggcgaagtatacaaaagcttccttagttgaagaagatgaaccagctgaaaaagaaaattccagcaaaaaagaagtaaaaataccta

SEQ ID NO: 57044 - DNA, 487 bp, Homo sapiens
  misc_feature 5, 6, 30, 31: n = A,T,C or G
attgnnatttcagagaaaaagcggacatgnnccttttctagccggaggattgctcctttttggccaaatgtatggagaagtagaaaaatcaaagcagttcatcaccctttccaggtctcggaatggtgctgaaaaatcctctccaacactgtggatggagatcggagaaacgcgactgtggtttctcttgatttctgaggatctcagaagtttcagcagacttccttgctctgtgttattcctttgcaaaaggaaagatcattatagcatgagggctgggaatagcagggtgaacttaacccaataaatgcaatttcctaaatgacttcatgctatggaggtgattctgattcaaatagcatgatccatgcttattatttaaggctgatttttaaaatcttgtgttgcaagggcaacctcgtccattttaactggcacctcagggattaaaatcctactttttagtgtagttcccacctcattcatg

SEQ ID NO: 57045 - DNA, 196 bp, Homo sapiens
  misc_feature 31, 148, 179: n = A,T,C or G
aattgacgttgtttatcaacttcgctagaanaaaaaaacacttggcatacaaaatatttaagtgaaggagaagtctaacgctgaactgacaatgaagggaaattgtttatgtgttatgaacatccaagtctttcttcttttttaagtngtcaaagaagcttccacaaaattagaaaggncaacagttctgagctgt

SEQ ID NO: 57046 - DNA, 489 bp, Homo sapiens
  misc_feature 7, 312, 324, 354, 362, 417: n = A,T,C or G
catggcnacactggataatggctttgtgatatttaaaaaatttttgtagcgactgtaaacagaaatgccaaattgatggttaattgttgctgcttcaaaaataagtataaaattaatatgtaaggaagcccattctttcatgttaaatacttggggtgggaggggagaaagggaaccttttcttaaaatgaaaataattactgctattttaaaatttcttgatcattgaatgtgagacccttctaacatgatttgagaagctgtacaagtataggcagagttattttcctgtttacattttttttttgtttnggggaaaaaatngggaggggtctaattactgtttacttcatngttatatngcagtaaaagttttaaaacaaccattgcatgtttgcttttgatgtatccctttgngaaattagcacttttggggccaatggagaaatgcagcattcactctccctgtcttttccccttccctcagca

SEQ ID NO: 57047 - DNA, 233 bp, Homo sapiens
agaatgggatctgaaactacagctttttgctattaaaccaaatacttgtgatctactttgtttgagcaaaacagcattatttgttatgttaatgatggttaatttccattttattggttttatgtttattttaatttgtaaatgttttagcatttattattgtatgtgaactatatttacctattttatgttgataaaaatataaaaaatattaaaataagtatatattaaga

SEQ ID NO: 57048 - DNA, 350 bp, Homo sapiens
  misc_feature 7: n = A,T,C or G
acatgcnaaatatgctcaatatcatcactcgtgatggaaacgcaagttaaaactgtaagaagatataccatacattcactaggatggttaaaattaaaacatctggcaataccaagtgttaaggaagttggccagaaccctcatatgttgctagtgagagtgtgaaagtggtacaaccactttggaaaatagtggcagtttcttatgacattaaatttgtacttgtcatatgacccagtaattccaggtatttataggcatctacccaagagaaataaaagcatatgtctaaacaaagacttgcacctgaatattcataaagcttttgtgataggctgagtaatgcctcc

SEQ ID NO: 57049 - DNA, 228 bp, Homo sapiens
  misc_feature 15: n = A,T,C or G
agaaccgggaaggtnaagtaacaatatggaaaacgctcccgtgaaaattcacaaggtctgttctaggatcatcaggctcttcggtgtgacttaagagttcagagcatgaaggaggagggggcagtaagaaaaatggagagaacgtagcatcagattctgcaggcaaggagaaaattgctaagctgggaaataacataatcagagcagtacttaagatgaatctaacgg

SEQ ID NO: 57050 - DNA, 490 bp, Homo sapiens
  misc_feature 7, 30, 31: n = A,T,C or G
agaagcncaaggtttccagtccctcatggnntcagtggatacggagattgtcacccagctacaggagtttttgcaaggattctaagagcacatgacatgtggctgcctcccctttcagaaacaagctgagtaacccagcctgccgtttgtatgtgagagcctgctgagatgaagaaatcacttcatgaaaataagcaagaccacacattttttactacaaaatgtaaaggataaatgtaaatcctgcataactaaaatcacaaacctattcctcaaaagaatttaattttatatttatgagggggccctttcactaaaaagtacatgtaaaagtacatttgatgacaatagctgcttagtttcctgttaagagaagaaactttatcttttaattatgtgctcttaatatttgaagatgagagttaatacctgagatgtttttctgcaaccaaaattcattaaatttggctgccttatcctttttttaagc

SEQ ID NO: 57051 - DNA, 488 bp, Homo sapiens
  misc_feature 31, 128, 163, 486: n = A,T,C or G
gctttttttttgaggaagacgcggtcgtaanggctgaggatttttggtccgcacgctcctgctcctgactcaccgctgttcgctctcgccgaggaacaagtcggtcaggaagcccgcgcgcaacagcnatggcttttaaggataccggaaaaacacccgtggngccggagggggcaatttcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttggggtgaaggttctaagacgtgggatcgtttccagatgagaattcacaagcgactcattgacttgcacagtccttctgagattgttaagcagattacttccatcagtattgagccaggagttgaggtggaagtcaccattgcagatgcntt

SEQ ID NO: 57052 - DNA, 459 bp, Homo sapiens
  misc_feature 11, 30, 451: n = A,T,C or G
agcatttaagnaagcatcctctgccaagtnccaaaaggaaagaagaaaaagggccaaaagccaaaatgaaactgatggtacttgttttcaccattgggctaactttgctgctaggagttcaagccatgcctgcaaatcgcctctcttgctacagaaagatactaaaagatcacaactgtcacaaccttccggaaggagtagccgacctgacacagattgatgtcaatgtccaggatcatttctgggatgggaagggatgtgagatgatctgttactgcaacttcagcgaattgctctgctgcccaaaagacgttttctttggaccaaagatctctttcgtgattccttgcaacaatcaatgagaatcttcatgtattctggagaacaccattcctgatttcccacaaactgcactacatcagtataactgcatttctagtttctatatagngcaataga

SEQ ID NO: 57053 - DNA, 335 bp, Homo sapiens
  misc_feature 7, 31, 138, 328, 329, 334: n = A,T,C or G
acttagntaattgtagggcgaggattataantgaaatttgcaaaatcacttagcggcaactgaagacaattatcaaccacgtggagaaaatcaaaccgagcagggctgtgtgaaacatggttgtaatatgcgactgcnaacactgaactctacgccactccacaaatgatgttttcaggtgtcatggactgttgccaccatgtattcatccagagttcttaaagtttaaagttgcacatgattgtataagcatgctttctttgagttttaaattatgtataaacataagttgcatttagaaatcaagcataaatcacttcaactgctnnaaaant

SEQ ID NO: 57054 - DNA, 473 bp, Homo sapiens
  misc_feature 6: n = A,T,C or G
aaccanttaaaatcccttttgttgatgagctattgagagctgcagtagtttgcttttagtattgttgttgcacttgagcagagacaaacctttattcatagtgtctacaggacatatgaagagtgcaatggcaaaacaagagcaaaaagcacttcctcccatgaccttacagtaaccatactgattgaatccccagggacattccatcattgcaatagctcagatttttcttcctttttctttgcacaccagctctactctttagtaaaattgtaaaaggctgccattatggacattaggtatcccaacataaccatctggagtgtgtccagtttgttcttcataggaccaatttttatttgcagcttgagtttttatatgaagttgcattattgtggacttggctgtcttgtgatgaatttttttcatatgtattctgtgccatactattgttaaaatgaactgttgctatt

SEQ ID NO: 57055 - DNA, 304 bp, Homo sapiens
  misc_feature 19, 25, 264, 265: n = A,T,C or G
ccaaactgcaaataggatnattttncaaaactatatggtgaaacatatggtgatatgatagacttatggtttttctgtttgctgggattgggtctgctttttgcctatgtgtaaggcattttaatcattgtgaatataatagattccttaaaataagaaaattaaaaatcagaaacttcccttggagtagagacatttcagttgcaagcataaagatttttaaatatataacactaggttatataattcatatatgtgtggttnngtatgaataatcaaatgaataaaaacattgcattggcta

SEQ ID NO: 57056 - DNA, 489 bp, Homo sapiens
  misc_feature 458: n = A,T,C or G
aactcggtggtggccactgcgcagaccagtacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggcagggaaggaaagaacttgcatgttggtgaaggaagaagtggggtggaanaagtggggtgggacgacagtgaaatctagag

SEQ ID NO: 57057 - DNA, 390 bp, Homo sapiens
  misc_feature 8, 11, 346, 357: n = A,T,C or G
actcgcgnccncatggaccgggggacattgccggcgtcttggcgattcggcccgacgagctccgctttcgctacagcatggtggcctactggagacaggctggactcagctacatccgatactcccagatctgtgcaaaagcagtgagagatgcactgaagacagaattcaaagcaaatgctgagaagacttctggcagcaacgtaaaaattgtgaaagtaaagaaggaataatctaccctgactaaagcttgaaatgctacatttccaaggtgaagatgtgtgggcacatgttatggcagattgaaaaggatctcattccatgggaaaaaaaaaaatcctgtctngttcataaatngacaatgtcaataaattgaaatatggttcactg

SEQ ID NO: 57058 - DNA, 479 bp, Homo sapiens
  misc_feature 9: n = A,T,C or G
cgcaatagnatatagtaccgcaagggaaagatgaaaaattataaccaagcataatatagcaaggactagcccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagggagtaaaaaatttaacacccatagtaggcctaaaagcagccaccaattaagaaagcgttcaagctcaacacccactacctaaaaaaatcccaaacatata

SEQ ID NO: 57059 - DNA, 500 bp, Homo sapiens
  misc_feature 3, 6: n = A,T,C or G
aanagnaccggggaatctttgcatagttaagcatttttgcctgtttacaattggacatactataagttatattctttctctttttctcttaacactcacacatacccatgtacacacctgcacacccgtacacatgatttaagtgatttaatagaattatatttgaaataaaaataacctcaaagtgtattttaagtgaaaaaaattctaatatatgatattatttagtaaaatttgacacattttacatatctatgttaaagcatctgaaagagccttcacagagatttttaaggaaagttgtttatgaatgagcatgatatgtgtattctttacattattttttcttgtccacattgtctatttttagtgatataataataaaaaattaaacaaaacaaaagagacaactaaagaacataatgttttaaaaagtttgactttaccccttttaacatctcaactgaaaatttatctcctgaccatcctaactgttaggc

SEQ ID NO: 57060 - DNA, 471 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaaggaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggt

SEQ ID NO: 57061 - DNA, 327 bp, Homo sapiens
  misc_feature 25: n = A,T,C or G
ccctagcaatggatccaaaccaagnagaaatctctgaattgccagataaggaattcagaagattggttattaagctactcaaggaaatagcagagaaaggtaaaaaccagcataaagaaattttaaaaaacaatacaggatatggatgaaaacttctgcagagaaatatcataaagaaaaaataaatcacagcttcaggaaatgaaagacacacttagagaaatacaaaatgtagtggaaagcttcaacaataggctagaacaagtagaagaaagaacttcagagcttgaagacaaggctcttgaattaactgaatcaagacaaaga

SEQ ID NO: 57062 - DNA, 116 bp, Homo sapiens
gctcctcgggaaggttgaggcaggagaattgcttgaacctgagaggcggaggttgcagtgagctgagattgcgccattgcactccagcctgggggacaagagcaagacttcgtctc

SEQ ID NO: 57063 - DNA, 500 bp, Homo sapiens
  misc_feature 3, 6: n = A,T,C or G
ccncanggaccgggggcagcaggaggaagcagctacccgaatacctgcttagttcctgaaaaggggagtgtaactagtggatttgggaaaggttcttaagtagatcctgagactatttgcatgcttctgtctaaatgataattaaaaggaaatttcatggattaaaccatgggtttaatgcagcaaggaaacttacaatgtccctttatatataacatgcatcttgttttggatttgtgtcattttttaatatagctgattgacttcacagaaagcagctttttttgaattctaatacataggtgtatatttggtattagttattttgagttcttttcaacttataacactgtatacaggttatttctaaagcacagatgaaataagttctgcatatttttaaataatcacagttccctgctatacagataatgttctcactacccataatatgtaggaacattgtttctccttagccgtagtatgcatacacctatcca

SEQ ID NO: 57064 - DNA, 500 bp, Homo sapiens
  misc_feature 43, 474, 477: n = A,T,C or G
agaagaaccgggatggagactttgtaccgtgtcccgttcttantgctcgaatgtcccaacctgaagctgaagaagccgccctggttgcacatgccgtcggccatgactgtgtatgctctggtggtggtgtcttacttcctcatcaccggaggaataatttatgatgttattgttgaacctccaagtgtcggttctatgactgatgaacatgggcatcagaggccagtagctttcttggcctacagagtaaatggacaatatattatggaaggacttgcatccagcttcctatttacaatgggaggtttaggtttcataatcctggaccgatcgaatgcaccaaatatcccaaaactcaatagattccttcttctgttcattggattcgtctgtgtcctattgagttttttcatggctagagtattcatgagaatgaaactgccgggctatctgatgggttagagtgcctttganaanaaatcagtggatactggatttgc

SEQ ID NO: 57065 - DNA, 138 bp, Homo sapiens
  misc_feature 16, 132, 138: n = A,T,C or G
gactcagtataaaatnactgaagtgtatcatgatttgattgtatcctgtaccaagactacttaccttgaatgctccaagatttaaaagtagtatgacatgttctcactctaaaataaacttttttttttttngggggn

SEQ ID NO: 57066 - DNA, 462 bp, Homo sapiens
  misc_feature 16: n = A,T,C or G
atctttaaattatttngctggcagaaaagaattacatttaaaactgaaatcaaggcctcaatacaaagattatcctggctcttttctatctctgtgggcctaattgaaatatgtactcttattttagacacgcctctgttaaaacagaccaggttttcctggtctcagacctatgatgacttgtccctttgatgtcactactgtgaattgaatataattagtaaaaatagacgatgaataaataacactttatagtaagaaaacaatatattttggccatctaaaaatgagaattataattatatgaattataatttaaactgtttaattttgtttaatgtgtatattgaatcttccaaattgaagccattattctcaattaagtactacaactatgacaatgcttgacctacatttctaaaataaaaattcacattttttgataaataaactacagtttta

SEQ ID NO: 57067 - DNA, 322 bp, Homo sapiens
  misc_feature 210, 321: n = A,T,C or G
atgggatttgagttgcaggtgtccacttaactgactagctttgataaacaatgtcagattttaactatgaaaacgacattaccttgtgcatttttatattgattcctattttttttttaagattaaagtttaaatgttttccactagtcatttcacttctaacttggtataggaagcttagctctctacatacctatcatgtgccctgtntcacagaagattcaggaaaaatgcacttgggaatcaaagaaaatggaacttctttttgaaaagacaagcaaccatgttaactgtattgacacatcctcaataaaacctgtng

SEQ ID NO: 57068 - DNA, 280 bp, Homo sapiens
aggccacaggaagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaatt

SEQ ID NO: 57069 - DNA, 415 bp, Homo sapiens
  misc_feature 405: n = A,T,C or G
agtcattggggggaaaatgtagccacattttttatgggaagactttgtgttagaagtgaacattttgaaggtttttaactggtgaaactagcctggaataatgccaccagagactgagtggaaatcgccccttttgaaggtgccattcttatgagccaaaagtttgtcatttaaaagttcattttgagggaataacatgtaatataatttgaaataaaggtatagtaaccttaaaaagaacattataactgattgttgtgaatggggtgaatttgttaaaatgagtaactttgataaagtttttcatgcacaggcaaaatgtattcactagatttctacgtagtgatctgcttttactttgtaatttgtaggtctcaaaagacttttttttaaaaaaataaaggnccatacttac

SEQ ID NO: 57070 - DNA, 500 bp, Homo sapiens
  misc_feature 2, 15, 476: n = A,T,C or G
gnaccgggggggtcnaatgaaggtgaattcaaggctgatggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggngctataataaataaacttcaacac

SEQ ID NO: 57071 - DNA, 482 bp, Homo sapiens
  misc_feature 4, 18, 42, 476: n = A,T,C or G
gagnggaccgggggtagncccgggtggttgctgccgaaatgngcaagttcatgaaacctgggaaggtggtgcttgtcctggctggacgctactccggacgcaaagctgtcatcgtgaagaacattgatgatggcacctcagatcgcccctacagccatgctctggtggctggaattgaccgctacccccgcaaagtgacagctgccatgggcaagaagaagatcgccaagagatcaaagataaaatcttttgtgaaagtgtataactacaatcacctaatgcccacaaggtactctgtggatatccccttggacaaaactgtcgtcaataaggatgtcttcagagatcctgctcttaaacgcaaggcccgacgggaggccaaggtcaagtttgaagagagatacaagacaggcaagaacaagtggttcttccagaaactgcggttttagatgctttgttttgatcattaaaaattntaagga

SEQ ID NO: 57072 - DNA, 488 bp, Homo sapiens
  misc_feature 20: n = A,T,C or G
aaaggtcttttatgcacagnaatacacttagtattgataggaaagaactcgtaatggagtttgagtaaagaaaatgactgatgtactaaacccagtaaaaattgttgaaaatgttaaaggtcagcatgttctaattgggaatctagatatagcttagatttcctattggcttagagtatttgctataacaaatgaagtgcaatgacaattatatattcctactcggtcatactggactggcttcgttctcttaatatactcagtaatgactcaagcctctggctattaacataccctagttgccgttttttaattgccatgagccaaatacttcttggtatacaattgatccatttattttaatggctgccttttcattttcatcttttcttgctgctacccatctatgtatgtagtcattggggggaaaatgtagccacattttttatgggaagactttgtgttaaaagtgaacattttgaaggttt

SEQ ID NO: 57073 - DNA, 462 bp, Homo sapiens
  misc_feature 41, 43, 64, 72, 102, 107, 155, 179, 218, 222, 252, 278, 346: n = A,T,C or G
tatggaccgggaaatgtcgattttttttttgcaccccatgntnttgattgctaaatgtaacagnctgatcgngacgctgaataaatgtcttttttttaatgngctgngtaaagttagtctactcttaagccatcttggtaaatttccccaacagngtgaagttagaattccttcagggngatgccaggttctatttggaatttatatacaacctgctngggnggagaagccattgtcttcggaaaccttggngtagttgaactgatagttactgttgngacctgaagttcaccattaaaagggattacccaagcaaaatcatggaatggttataaaagtgattgtnggcacatcctatgcaatatatctaaattgaataatggtaccagataaaattatagatgggaatgaagcttgtgtatccattatcatgtgtaatcaataaacgatttaattctctca

SEQ ID NO: 57074 - DNA, 296 bp, Homo sapiens
  misc_feature 3, 17, 44, 262, 294: n = A,T,C or G
tanggaccggggaattncaaaaatgtcctgccagtttaagggtncattgtagagccgaattttgagttactgtgcaagatttttttttcatgctgtcatttgtaatatgttttgtgagaatccttgggattaaagttttggttacaaattgttctttaacttgaaagcctgtttttccttgcaaactcaaatctgtgagcttggtaccaagtccaggtataacattcctattggaagccatacttatattttcttgtaaagngcttttgaattaataaaatattagcataaaanga

SEQ ID NO: 57075 - DNA, 307 bp, Homo sapiens
  misc_feature 31, 33, 234: n = A,T,C or G
caccgcccgtccccgcccccttgcctctcgntnccccctcgatgctcttagctgagtgtcccgcggggccccgaagcgtttactttgaaaaaattagagtgttcaaagcaggcccgagccgcctggataccgcagctaggaataatggaataggaccgcggttctattttgttggttttcggaactgaggccatgattaagagggacggccgggggcatttcgtattgcgccgntagaggtgaaattcttggaccggcgcaagacggaccagagcgaaagcttttgccaagaatgttttcatttatt

SEQ ID NO: 57076 - DNA, 499 bp, Homo sapiens
  misc_feature 18, 41: n = A,T,C or G
atggaccggggaaagccncagtgacattgggtgactgctgnttggaaaactgtccacacttgctactctttgagaatgaagttgtcattcagggcccctcatgtagccaaaagaccaagaaaaatctggcccacagataagttgcagactgcctttaaaatagattttatcagtggagaaatggtgatagttttttcttcagttttctcttgggaagagttttatgttgtttaaaagatattttgataacttaacctgctttatgggcttacataatattcctttcatccattctttttaaagaacggcttacctttcctatttatttttagggtgattttttaaaaagacttgtgcaatacattttgaggtgaaacttagtggattttttctgataaattagagcatttaattgactattttattcaggttgatctgttgaatatttgctaaagaccagttctttaagctaagacatgtaaaaaatcccaaatggcag

SEQ ID NO: 57077 - DNA, 427 bp, Homo sapiens
  misc_feature 5, 42, 43, 382, 425: n = A,T,C or G
catgnaccgggaatccacctttgggtcgctttgctgttcgtnntatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttactagtttttaaaatcagtactttttaatggnaacaacttgaccaaaaatttggccacagaattttggagacccntt

SEQ ID NO: 57078 - DNA, 500 bp, Homo sapiens
  misc_feature 4, 6, 311: n = A,T,C or G
cacngnatttggtttgaacattatttcttgaaactatctaatgagctcattcagtttggactataattgattcccagcctttaagttcaggattgaggcaaggctcctaaaaggaaaaaaacaataatgtttcttcaaacaaatttgtctacataaggaagaagataatacaagttgttacaaaagcggtatagctgaactgctttcaaccaaaaatgggatttatcttcttgacttaaacaactagaacaccagaaaaaaaatatatgaaacaacagttatcagactctgaacaataaacaacatagagnggtcatctataaaagaagagaaacaaatgaggcaagccctacgactgccccagcatactctctggagagaaattccaggccaagatccagaagaaaaaattaaaacaaagcctaggagtctccctgagttaaggagacagaattcagagtttgcaaaggccaaagctgctagaattcacagcacagagt

SEQ ID NO: 57079 - DNA, 100 bp, Homo sapiens
  misc_feature 81: n = A,T,C or G
aagagcccaacagtgaaaatgtagcatatcagcagtggaagaggcgtgacaggctggaagagcaaatgctggtgagcatgnctgctgggggatgagggtg

SEQ ID NO: 57080 - DNA, 500 bp, Homo sapiens
  misc_feature 5, 7, 29: n = A,T,C or G
aaagncnttcctgagctgacagcattcgngccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattgatatgcttatacacttacactttatgc

SEQ ID NO: 57081 - DNA, 314 bp, Homo sapiens
  misc_feature 5, 15, 41, 59, 305: n = A,T,C or G
aagtnggcttcaagnaagcgtgcacctcggtcactcaaagnagattcggaaatttgccntgaaggagatgggaactccagatgtgcgcattgacaccaggctcaacaaagctgtctgggccaaaggaataaggaatgtgccataccgaatccgtgtgcggctgtccagaaaacgtaatgaggatgaagattcaccaaataagctatatactttggttacctatgtacctgttaccactttcaaaaatctacagacagtcaatgtggatgagaactaatcgctgatcgtcagatcaaataaagttntaaaattgc

SEQ ID NO: 57082 - DNA, 497 bp, Homo sapiens
  misc_feature 4, 33, 44: n = A,T,C or G
caanaaccgggggaagctggagatgaactcggnacctcaaggtntcagctcagggagctgaatattacggcagctaaggaaattgaagttggtggtggtcggaaagctatcataatctttgttcccgttcctcaactgaaatctttccagaaaatccaagtccggctagtacgcgaattggagaaaaagttcagtgggaagcatgtcgtctttatcgctcagaggagaattctgcctaagccaactcgaaaaagccgtacaaaaaataagcaaaagcgtcccaggagccgtactctgacagctgtgcacgatgccatccttgaggacttggtcttcccaagcgaaattgtgggcaagagaatccgcgtcaaactagatggcagccggctcataaaggttcatttggacaaagcacagcagaacaatgtggaacacaaggttgaaactttttctggtgtctataagaagctcacgggcaaggatgttaattttgaatt

SEQ ID NO: 57083 - DNA, 162 bp, Homo sapiens
agaggtattcgaccattcactggctgagccagatcacgggaacttgagagcttttactgtgattcttcaatgtaaaaaataaacaacaatgtcaaactgtgtttatatgatttgtataaagcctttttaagattactatttaaataaacattataccagaga

SEQ ID NO: 57084 - DNA, 150 bp, Homo sapiens
  misc_feature 13, 14: n = A,T,C or G
gaccggggaagannttttgagaatgagcgagaccatgttcacataacttttgtatggtatattgttccgttttcttattggttattgctgttcatttgttactgtgccagatttataaattaaacttgattataggtatatacctatagg

SEQ ID NO: 57085 - DNA, 417 bp, Homo sapiens
  misc_feature 3, 23: n = A,T,C or G
tanataaaccggaaaaggccagnaagcagcccatcacatgcaagtagtataatccataggattaccagcagttttcttattagaaactttggaggccagaaggcagtgggccaaaatgttcaaagtgcaaaaagaaaaaactgtcaactaagaatcgtttgtctgtccaaactgtccttcaaacatgagggataaattaaggcattcacagacgaacaaaagctgatggagtttgttaccactagacctgccttgtaagaaatgctcaaggtaatcctgcaggatgaaatgagaagacaacagacagtaacttgatgctatatgaagaaataaagatctcaatagagataaattcatgagcaatatacaagctagtttataacttcacattttgttttctacatattttaagagact

SEQ ID NO: 57086 - DNA, 431 bp, Homo sapiens
  misc_feature 5: n = A,T,C or G
ttaancgaataagcgtacacggtggatgcttaggcaatcggaggcgatgaaggacgtgctaatctgcgaaaagcgtcggtaaggtgatatgaaccgttatacccgacgatatccgaatggggaaacccagtatccaatggatactatcattaactgaatccataggttaatgaggcgaaccgggagaactgaaacatctcagtaccccgaggaaaagaaatcaaccgagattcccctagtagcggcgagcgaacggggagcagcccagagtcttaatcaatagcagtgtcaggagaacggtctggaaagtccggcagtaaagggtgatagccccgtatctgaagatgctgttattgtgaactcgatgagtagggcgggacacgtgttatcctgtctgaatatggggggaccatcctccaaggctaaatact

SEQ ID NO: 57087 - DNA, 406 bp, Homo sapiens
  misc_feature 31: n = A,T,C or G
tacaccaatagacatcaaactcaatgctttntttgtaaatttagtgtttttttatttctactgtcaaatgatgtgcaaaaccttttactggttgcatggaaatcagccaagttttataatccttaaatcttaatgttcctcaaagcttggattaaatacatatggatgttactctcttgcaccaaattatcttgatacattcaaatttgtctggttaaaaaataggtggtagatattgaggccaagaatattgcaaaatacatgaagcttcatgcacttaaagaagtatttttagaataagaatttgcatacttacctagtgaaacttttctagaattatttttcactctaagtcatgtatgtttctctttgattatttgcatgttatgtttaataagctactagc

SEQ ID NO: 57088 - DNA, 423 bp, Homo sapiens
  misc_feature 23: n = A,T,C or G
aagtttttaacgtaattttaatngcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatggaaagattaattgggagtg

SEQ ID NO: 57089 - DNA, 500 bp, Homo sapiens
  misc_feature 444: n = A,T,C or G
tctattcataagagaaacatttatttatgaaaaaaattgaaaaggggatagatcacaactcctgaattgatcttctaagtgaaacagtctcaaggaaaataaaataagcttcctgagtatcacttaaatctatcacaatcatagaatcaaaccactcttcagaactggaaggaataggaactgcataccacatagagagcaataaggtcctagaagcaccaacaggccactaaaatggcccagtaaaaaatcagatgccagtttggggttgtaaaaactcctaagttccaatcttcataatactttttgactttgcatatggaagcacaaccaggaaactatgtaggccatattcatagcataaccatgtacccctaagcccaacccaatagtgatgaaaatggccttttcaaagtcaaaagaaagattttggaaagcattgcntaagagcataaaaaacaaaagaccttgtgatccaaaagaagctaagagtgctgggg

SEQ ID NO: 57090 - DNA, 466 bp, Homo sapiens
  misc_feature 7: n = A,T,C or G
gaagggnctgtatagcagaaccctggctggtagcatcacaacacctcctctgcttatcgtattttatcaacagcactctaccatcgatcctatgtggaatgtccgccaccttggttccagtgctggaaaacgatattcacctcagtttgtaaaggctgccaagttactccattggaatggacatttgaagccatggggaaggactgcttcatatactgatgtttgggaaaaatggtatattccagacccaacaggcaaattcaacctaatccgaagatataccgagatctcaaacataaagtgaaacagaatttgaactgtaagcaagcatttctcaggaagtcctggaagatagcatgcgtgggaagtaacagttgctaggcttcaatgcctatcggtagcaagccatggaaaaagatgtgtcagctaggtaaagatgacaaactgccctgtctggcagtcagct

SEQ ID NO: 57091 - DNA, 166 bp, Homo sapiens
  misc_feature 153, 155: n = A,T,C or G
ccagaatataatgtgcaggcaatcgtggatgtctctgacaaagtgtgtctcaaaaataatatacttttacattaaagaaatttaatgtttctctggagttggggctcttggctttcagagtttggttaatcagtgttgattctagatgatcancntaatggaccac

SEQ ID NO: 57092 - DNA, 376 bp, Homo sapiens
ctcagtgaaaatccaaaaaccccaaaaaaatgtttatacaaccctaagtcaataacctgaccttagaaaattgtgagagccaagttgacttcaggaactgaaacatcagcacaaagaagcaatcatcaaataattctgaacacaaatttaatatttttttttctgaatgagaaacatgagggaaattgtggagttagcctcctgtggtaaaggaattgaagaaaatataacaccttacaccctttttcatcttgacattaaaagttctggctaactttggaatccattagagaaaaatccttgtcaccagattcattacaattcaaatcgaagagttgtgaacctgttatcccattgaaaagaccgagccttgtat

SEQ ID NO: 57093 - DNA, 282 bp, Homo sapiens
  misc_feature 18, 46: n = A,T,C or G
tatggaccggggaaaggnctatcagtgagcctgaatggaaaaaacnttgaagacgtcattgcccagggtattggcaagcttgccagtgtacctgctggtggggctgtagccgtctctgctgccccaggctctgcagcccctgctgctggttctgcccctgctgcagcagaggagaagaaagatgagaagaaggaggagtctgaagagtcagatgatgacatgggatttggcctttttgattaaattcctgctcccctgcaaataaagcctttttacacatct

SEQ ID NO: 57094 - DNA, 282 bp, Homo sapiens
  misc_feature 15, 20, 28, 42: n = A,T,C or G
agaccgggggtcccncaaancagcaagnaagtatgctgaggntgtcactcgggctaagcagattgtgtggaatggtcctgtgggggtatttgaatgggaagcttttgcccggggaaccaaagctctcatggatgaggtggtgaaagccacttctaggggctgcatcaccatcataggtggtggagacactgccacttgctgtgccaaatggaacacggaggataaagtcagccatgtgagcactgggggtggtgccagtttggagctcctggaaggtaaagt

SEQ ID NO: 57095 - DNA, 466 bp, Homo sapiens
  misc_feature 19, 457: n = A,T,C or G
tatggaccggggaaattcnacaattaatattcatcgcacttcttctgtggaaggactttgtgaaggaattggtgctggattagtggatgttgctatctgggttggcacttgttcagattacccaaaaggagatgcttctactggatggaattcagtttctcgcatcattattgaagaactaccaaaaataaatgctttaattttcatttgctacctctttttttattatgccttggaatggttcacttaaatgacattttaaataagtttatgtatacatctgaatgaaaagcaaagctaaatatgtttacagaccaaagtgtgatttcacactgtttttaaatctagcattattcattttgcttcaatcaaaagtggtttcaacattttttttagttggttagaatactttcttcatagtcacattctctcaacctataatttggaatattgttgngggcttttg

SEQ ID NO: 57096 - DNA, 221 bp, Homo sapiens
  misc_feature 16, 30: n = A,T,C or G
attgtctaaattattnttgtataatttgtntaaatttacaagttataaatttgtataaaattgtataaataaaaatacaaaaattagccggatgtggtggcacatgcctgtagtcccagctactcaggaggctgaggcatgagaaccacttgagccttggagacagaggttgcagtgagctgagatcgcaccactgcagcccagcctgggcaacgtgtctc

SEQ ID NO: 57097 - DNA, 434 bp, Homo sapiens
  misc_feature 40, 418: n = A,T,C or G
gaccgggggaacaactcggtggtggccactgcgcagaacnagaacttcgctcgtactcgtgcgcctcgcttcgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggntggcagggaaggaaag

SEQ ID NO: 57098 - DNA, 401 bp, Homo sapiens
  misc_feature 7, 39, 387: n = A,T,C or G
aaccggnattctcctaaataatattcttgtaaagaaaantaaacctttactccttaagtctttgaagatacacgtcatagagttgaaaatgattttaaagagtacatatggccaagaaatatgaaaaaaaagttcagcatctctaatcatcagaggaatgcaaattaaacccacaaaaagataccatcttacacagatcagaatgcctattattgaaaagtcaaaaaacaactgacacctgcaaggatgcagagacaaaggaacacgtatatactgttttggggaatgtaaattagtacaacatctgtgggaaacagtatggagagttttcaaagaactaaaaatagaactaaactttgatccagcaatcccactactgcatgttgngttttatccaaagg

SEQ ID NO: 57099 - DNA, 125 bp, Homo sapiens
gttttttagcagtttaatgggtacattttagagtcttccattttgttggaattagatcctccccttcaaatgctgtaattaacaacacttaaaaaacttgaataaaatattgaaacctcatcctc

SEQ ID NO: 57100 - DNA, 349 bp, Homo sapiens
  misc_feature 262, 266, 342: n = A,T,C or G
aagagtggagaatactgggttgaccctaaccaaggatgcaaattggatgctatcaaggtattctgtaatatggaaactggggaaacatgcataagtgccaatcctttgaatgttccacggaaacaccggtggacagattctagtgctgagaagaaacacgtttggtttggagagtccatggatggtggttttcagtttagctacggcaatcctgaacttcctgaagatgtccttgatgtgcagctggcattccttcgacttntctncagccgagcttcccagaacatcacatatcactgcaaaaatagcattgcatacatggatcaggccagtggaaatgtnaagaagg

SEQ ID NO: 57101 - DNA, 104 bp, Homo sapiens
  misc_feature 17: n = A,T,C or G
acttcgctcgtactcgngcgcctcgcttcgcttttcctccgcaaccatgtctgacaaacccgatgtggctgagatcgagaaattcgatgagtcgaaactgaaga

SEQ ID NO: 57102 - DNA, 478 bp, Homo sapiens
  misc_feature 15: n = A,T,C or G
gaaccggggaaaagngcaaaatgcaggtgttttctcagtttcacagaccagctctgcagcaggggattggggagcccaggaggcagccttcccttttgccttaagtcacccatcttccagtaagcagtttattctgagccccgggggtagacagtcctcagtgaggggttttggggagtttggggtcaagagagcataggtaggttccacagttactcttcccacaagttcccttaagtcttgccctagctgtgctctgccaccttccagactcactcccctctgcaaatacccgcatttcttaccctggtgagaaaagcacaagcggtgtaggctccaatgctgctttcccaggagggtgaagatggtgctgtgctgaggaaaggggatgcagagccctgcccagcaccaccacctcctatgctcctggatccctaggctctgttccatgagcctgttgcaggttttggtactttag

SEQ ID NO: 57103 - DNA, 128 bp, Homo sapiens
  misc_feature 25: n = A,T,C or G
tagaaacatgctcaaataacattcngaaagaacaaaaagtcatgggaaattttttattttacaacaaagccctgctttctttctggacgtattttacatcattagagagactatctgcacatacatct

SEQ ID NO: 57104 - DNA, 458 bp, Homo sapiens
  misc_feature 32: n = A,T,C or G
aagaacaaacactaatgttaattgcccaattnagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacact

SEQ ID NO: 57105 - DNA, 156 bp, Homo sapiens
  misc_feature 24: n = A,T,C or G
cggagccgagagccacactttcangtaaaccaggtggtggagaccccatccttggctgcttgcagggccactgtccaggcaaatgccaggccttgtccccagatgcccagggctcccttgttgcccctaatgctctcagtaaacctgaacacttgg

SEQ ID NO: 57106 - DNA, 440 bp, Homo sapiens
  misc_feature 7, 32, 142: n = A,T,C or G
gacattntagataagtagtacatggtggatancttctacttttaggaggactactctcttctgacagtcctagactggtcttctacactaagacaccatgaaggagtatgtgctcctattattcctggctttgtgctctgcnaaacccttctttagcccttcacacatcgcactgaagaatatgatgctgaaggatatggaagacacagatgatgatgatgatgatgatgatgatgatgatgatgatgaggacaactctctttttccaacaagagagccaagaagccatttttttccatttgatctgtttccaatgtgtccatttggatgtcagtgctattcacgagttgtacattgctcagatttaggtttgacctcagtcccaaccaacattccatttgatactcgaatgcttgatcttcaaaacaataaaattaagg

SEQ ID NO: 57107 - DNA, 266 bp, Homo sapiens
  misc_feature 13, 17, 39, 230: n = A,T,C or G
tatggcgcggggntttnttttcgcctcttttgtctttcngtggcgctgccccaataaaaggtcgagctgtgcagttttagcgggtacaagatctaccccggacacgggaggcgctacgccaggaccgacgggaaggttttccagtttcttaatgcgaaatgcgagtcggctttcctttccaagaggaatcctcggcagataaactggactgtcctctacagaaggaagcncaaaaagggacagtcggaagaaattcaaaagaaaag

SEQ ID NO: 57108 - DNA, 152 bp, Homo sapiens
  misc_feature 151, 152: n = A,T,C or G
atattctaccattaaaatactttttgcatgattgaatctattctatttatgttaattttatttgttcatgatagagtcactttgtattctggcattaaaaaataatatctagtgaaattaaacctatctgtattattctcatgctgccctnn

SEQ ID NO: 57109 - DNA, 244 bp, Homo sapiens
  misc_feature 25: n = A,T,C or G
aaaaatatggtctcaaaactagacngacagtacatcaaaagaaaactaggggtcaacatatctcataatcttatgtctaaaaatctcaatatggcaaataaaatccagtaatgtataaaaaagaagtattcaccatgaacaagtagaatttattccagtaatgccaagttggtttaatatttgaaaatcaatcaatgcaattcaccatatgaacaggctaaaggagaaaaatcatgtgatcata

SEQ ID NO: 57110 - DNA, 104 bp, Homo sapiens
  misc_feature 54: n = A,T,C or G
aggcgaaatgtaatactggaataatttgttaatgattttaattttatattcagngaaaagattttatttatggaattaaccatttaataaagaaatatttacct

SEQ ID NO: 57111 - DNA, 339 bp, Homo sapiens; identical to SEQ ID NO: 33124
  misc_feature 24: n = A,T,C or G

SEQ ID NO: 57112 - DNA, 498 bp, Homo sapiens
  misc_feature 41, 43: n = A,T,C or G
caagaaccggggaaatctgttcagtttttgaattttaatantnactccaattcagtaaatggtatcactgtttaccccttttaaagatatgattagacttcgttagtaatgttcaacttttcacaaagatggtgagtgccatcttaaaacttactggagattggttttatatttagatttatataactggttatgtgaatatatttaaatactggggaaattgcttcactgtcttagaaccaagcaagattcacctgtgttttgtgttcatgttcatttgcctcttaaaggcaagggttgaagataaataaggtagcaatgtctatagttttggccttaactatgccaatctaattataattccctgtatttaaaatggtttcttttacttattgaaaggcattttagtgtggtttatgtgtaatattaaagattattcaacacctctcacatcttacagatctataaggtcacatgcttttaaaatagtagcaagtt

SEQ ID NO: 57113 - DNA, 204 bp, Homo sapiens
  misc_feature 10, 17, 179, 190, 198: n = A,T,C or G
atacaacagnaaaccgnaaaagcaatactgtttccattttaaggatatgattaatattattaatataataatgatgatgatgatgatgaaaactaaggatttttcaagagatctttctttccaaaacatttctggacagtacctgattgtatttttttttttaaataaaagcacaagtncttttgagttngttatttngctttg

SEQ ID NO: 57114 - DNA, 244 bp, Homo sapiens
  misc_feature 6, 30: n = A,T,C or G
aactgnaaacagctgacagtggattttgtnaaccagtccgtgctacaaatcagcagtcaggatgtggaaagtaagcgtagtgataagactgattttgctgagcaacttggagcaatgaataaaagttggcaaattctgcaaggtctagtaactgagaagatccagctgttggaaggcttattggaatcttggtcagaatatgaaaataatgtacaatgtctgaaaacatggtttgaaacccagg

SEQ ID NO: 57115 - DNA, 463 bp, Homo sapiens
  misc_feature 4, 27, 30, 430: n = A,T,C or G
aagncccgggtggttgctgccgaaatnttnagttcatgaaacctgggaaggtggtgcttgtcctggctggacgctactccggacgcaaagctgtcatcgtgaagaacattgatgatggcacctcagatcgcccctacagccatgctctggtggctggaattgaccgctacccccgcaaagtgacagctgccatgggcaaggaagaagatcgccaagagatcaaagataaaatcttttgtgaaagtgtataactacaatcacctaatgcccacaaggtactctgtggatatccccttggacaaaactgtcgtcaataaggatgtcttcagagatcctgctcttaaacgcaaggcccgacgggaggccaaggtcaagtttgaagagagatacaagacaggcaagaacaagtggttcttccagaaactgcggntttagatgctttgttttgatcattaaaaatttt

SEQ ID NO: 57116 - DNA, 500 bp, Homo sapiens
gtttatggagagtaccttctctgcagcggacaatgatcagatatttcacatcgaatccagcctcaaaggtcctttgttctccaatgttgctgtcaacattcagtcacttctccttatttcacatggcagcaaatatgtatgttttgtggagcttctcttccagcatagtgaacattctgggtcaagagcagttcatggcagtgtacctatctgcaggtgttatttccaattttgtcagttacctgggtaaagttgccacaggaagatatggaccatcacttggtgcatctggtgccatcatgacagtcctcgcagctgtctgcactaagatcccagaagggaggcttgccattattttccttccgatgttcacgttcacagcagggaatgccctgaaagccattatcgccatggatacagcaggaatgatcctgggatggaaattttttgatcatgcggcacatcttgggggagctctttttggaatatggtatgttact

SEQ ID NO: 57117 - DNA, 283 bp, Homo sapiens
  misc_feature 15: n = A,T,C or G
atcaacggctttgcncatttctatatgagtgggtttactggtaaattatgttattttttacaactaattttgtactctcagaatgtttgtcatatgcttcttgcaatgcatattttttaatctcaaacgtttcaataaaaccatttttcagatataaagagaattacttcaaattgagtaattcagaaaaactcaagatttaagttaaaaagtggtttggacttgggaacaggactttatacctcttttactgtaacaagtactcattaaaggaaattgaatg

SEQ ID NO: 57118 - DNA, 496 bp, Homo sapiens
  misc_feature 24, 25: n = A,T,C or G
gctgtaggacggttgctccgagcnncggttgcccgacatgtgagtgccattccttggggcatttctgccactgcggccctcaggcctgctgcatgtggaagaacgagcttgacaaatttattgtgttctggttccagtcaagcaaaattattcagcaccagttcctcatgccatgcacctgctgtcacccagcatgcaccctattttaagggtacagccgttgtcaatggagagttcaaagacctaagccttgatgactttaaggggaaatatttggtgcttttcttctatcctttggatttcacctttgtgtgtcctacagaaattgttgcttttagtgacaaagctaacgaatttcacgatgtgaactgtgaagttgtcgcagtctcagtggattcccactttagccatcttgcctggataaatacaccaagaaagaatggtggtttgggccacatgaacatcgcactcttgtcagacttaactaagcagattt

SEQ ID NO: 57119 - DNA, 188 bp, Homo sapiens
acatcccgttgtacctgaagggcggcatcgttgacaacatcctgtaccgagtgacaatgacgctgtgtctgggcggcactgtctacagcttgtactcccttggctgggcctccttccccaggaattaagaccaagaagcctggggggcctgagagacttgaacaagtgtcaataaacgctggcctctg

SEQ ID NO: 57120 - DNA, 500 bp, Homo sapiens
  misc_feature 5, 43: n = A,T,C or G
tatgnaccggggggcccaggtgcgggtcgcctccagaatattntgtgccttcaaaccctacgagtccatactttaaaacaaaatgaagaaagtaaggcttaaggaactagagagtcgcctgcaacaagtggatggatttgaaaagcccaagctacttctggaacagtatcctaccaggccgcacattgcagcatgtatgctctatacaatccataacacttatgatgacattgaaaataaagtcgttgcagatctaggatgtggttgtggagtacttagcatcggaactgcaatgttaggagcagggttgtgtgttggatttgacatagatgaagacgcattggaaatatttaataggaatgcagaagagtttgagttaacaaatattgacatggttcaatgtgatgtgtgcttattatctaacagaatgtccaagtcattcgatacagtaattatgaatcctccctttgggaccaaaaataataaagggacagatatgg

SEQ ID NO: 57121 - DNA, 401 bp, Homo sapiens
  misc_feature 24: n = A,T,C or G
ccgacgttacaatggtggagttgncaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccagaagaaactgaagaaacaaaaacttatggcacgggagtaaattcagcattaaaataaatgtaatt

SEQ ID NO: 57122 - DNA, 476 bp, Homo sapiens
  misc_feature 3, 5: n = A,T,C or G
tangnaccgggaaaatactgaacacttagcctttctatgcgcttaatggtgtaaaagttagatggttaggtgtttgacaaacagatggttgcaattcagttacagactggggaaatagcccagtgtttgggattaaaactgtcaagactggataggtgttagtcatcactgtctttcgtccagtggggatttaataaatactttcaagcttctggtttgggagtttagataggtttgattttggatttgtaaatagtgattgctaaatttggtcagatttctcctgactggctgttcctaaattcttaggatatgtcccagtaaaattatactttgtgaattaattgtcatatgtgtaattgttgcattttggatgtacctaatttgataattaaaacaaaaataatttccgtttaaggtatcttgtttgcaggtcagaaaatgagaaaatgtaattgtgtaatgctctgaaatat

SEQ ID NO: 57123 - DNA, 496 bp, Homo sapiens
  misc_feature 3, 25, 45: n = A,T,C or G
aanagaaccggggaacaaccttagnccaaacctttacccaaattnagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaaaatttaacacccatagtaggcctaaaagcagcca

SEQ ID NO: 57124 - DNA, 500 bp, Homo sapiens
  misc_feature 2, 13, 39, 41: n = A,T,C or G
gnccggggtatcncccaatatacaaattattctgttagntnacatgtttttgttctccatgtttctgtttctattgtggtatgagttgtatttgtatcactgagataacctattgttatattctaattcattgataatatgttttgtaagaaaagctgacatccttcattgcaagtgaagaacaggtttaccatgaaatgaatgcctttattcaacttagagtcctaatgtttctgatttcacattcttgttgctgaaatgcagaagaaacagctacagcaagagcagaaggaaaactcttagacttaatgtctccaattgcaagaattgtttcactaaagaaacagtcatcattcaactactgaatttgaaagcctcagcagtttcaatgacaaaaatcatttttgattttttaaaattaatcccaatggcatgataaattttcatataaaaagtaaagtttcaatttagtttttaataatgggttaatgccttttttg

SEQ ID NO: 57125 - DNA, 224 bp, Homo sapiens
  misc_feature 25, 213: n = A,T,C or G
caactttttcattccctgcccccantttcccagactagatttcaagctaattttctttttctgaagcctctaacaaatgatctagttcagaaggaagcaaaatcccttaatctatgtgcaccgttgggaccaatgccttaattaaagaatttaaaaaagttgtaatagagaatatttttggcattcctctaatgttgtgtgtttttttttttngggggcggggg

SEQ ID NO: 57126 - DNA, 385 bp, Homo sapiens
  misc_feature 16, 41, 66: n = A,T,C or G
aaccgggaagtgaccngtctttgttatgacagtgaatattncttttattattattattgctgaagnggttgcattctactagcaggcaatgctgtacttttcttcagtcctcctctcctttttattttaggcactgttcaatactgtatgccttctgtattttaatggagtggatagcattgttttcttttacagactagcaggctactgggacctaaaaaggtctgttaatgtcatggccttgaaacagttccatttatgctggttaagagatcccttaagaagttagaaggcttaagaactgcttcatgtgaacatcccttattagttacaaagttatattcacagttttttaaaaatgtgtcaaaataaaggataactctgt

SEQ ID NO: 57127 - DNA, 275 bp, Homo sapiens
ctggagtctgggtcttccgaggccaggagcttgcctttccgctgagtccagattggcaggtggactacgagtcatacacatggcggaaactggatcctggcagcgaggagacccagacgctggttcgagagtacttttcctgggagggggccttccagcatgtgggcaaagccttcaatcagggcaagatcttcaagtgaacatctcttgccatcacctagctgcctgcacctgcccttcagggagatgggggtcattaaaggaaactgaacatc

SEQ ID NO: 57128 - DNA, 198 bp, Homo sapiens
  misc_feature 3, 5, 45: n = A,T,C or G
cangnaccggggcagaacctgcggaaagatgaatgccagaggtanttggatctgagctaaaggacagtattccagttactgaactttcagcaagtggaccttttgaaagtcatgatcttcttcggaaaggtttttcttgtgtgaaaaatgaacttttgcctagtcatccccttgaattatcagaaaaaaatttccagc

SEQ ID NO: 57129 - DNA, 408 bp, Homo sapiens
  misc_feature 30: n = A,T,C or G
gtgggctgacatctgcaggccgaagagccntggccttggaaagggccacaagttccaccacactattggtggctctcgccgggcagcttggagaaggcgcaatactctccagctccaccgttaccgctaatataagtaaagtttgtaaaattcatacttaataaacaatttaggacagtcatgtctgcttacaggtgttatttgtctgttaaaactagtctgcagatgtttcttgaatgctttgtcaaattaagaaagttaaagtgcaataatgtttgaagacaataagtggtggtgtatcttgtttctaataagataaacttttttgtctttgctttatcttattagggagttgtatgtcagtgtataaaacatactgtgtggtataacaggcttaataaattcttt

SEQ ID NO: 57130 - DNA, 436 bp, Homo sapiens
  misc_feature 3, 42, 435: n = A,T,C or G
tangaaccggggctctcggccttagcgccatttttttggatncctctgcgccatgagagccaagtggaggaagaagcgaatgcgcaggctgaagcgcaaaagaagaaagatgaggcagaggtccaagtaaaccgctagcttgttgcaccgtgggggccacaggagcagaaacatggaatgccagacgctggggatgctggtacaagttgtgggactgcatgctactgtctagagcttgtctcaatggatctagaacttcatcgccctctgatcgccgatcacctctgagacccaccttgctcataaacaaaatgcccatgttggtcctctgccctggacctgtgacattctggactatttctgtgtttatttgtggccgagtgtaacaaccatataataaatcacctcttccgctgttttagctgaagaattaant

SEQ ID NO: 57131 - DNA, 145 bp, Homo sapiens
aaatatattgctacgaagactttttaaatgtgcttgagatccaaataaagttaatagttacagtgaaggaattgagaaaattaaaagctttggaagaaaaacatagcggagtttgcaaaacattgtggtaagcttaaaaaaaaaa

SEQ ID NO: 57132 - DNA, 145 bp, Homo sapiens
  misc_feature 4, 6: n = A,T,C or G
atangnaccggggggcatccgggtgcagcaggggctatggcttttacaccaaagtgctcaactacgtggactggatcaagaaagagatggaggaggaggactgagcccagaattcactaggttcgaatccagagagcagtgtgga

SEQ ID NO: 57133 - DNA, 500 bp, Homo sapiens
aaccgggcaaaaatagcattgcatacatggatcaggcctgtggaaatgtaaagaaggccctgaagctgatggggtcaaatgagggtgaattcaaggctgaaggaaatagcaaattcacctacacagttctggaggatggttgcaccgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgtttta

SEQ ID NO: 57134 - DNA, 198 bp, Homo sapiens
  misc_feature 13, 65: n = A,T,C or G
aaccgggctacancaaaaagaaattttgcctgccattttcagaatcatcttttgaagctttctgntgatgttaactgagctactagagatattcttatttcactaaatgtaaaatttggagtaaatatatatgtcaatatttagtaaagcttttcttttttaatttccaggaaaaaataaaaagagtatgagtcttct

SEQ ID NO: 57135 - DNA, 316 bp, Homo sapiens
  misc_feature 3, 29, 43, 312: n = A,T,C or G
agnggaccgggctggagaccacacccagnaacagtatctggtntctaatctgtgtttagtaagtgttactgggctgaaagaccacacccaaaacagtgtctggtatctaatctgtgtaaataagtgttactgggctggaccaaacaattttgaggtagtcacaattcagtgtcttaaagtgtatataaacacggctgggtgcggtggctcacgcctgtaatcccagcactttgggaggcggaggcgggcttatcacgaggtcaggagatcaagaccatcctggctaatacggtgaaacctcgtctctactanaaat

SEQ ID NO: 57136 - DNA, 500 bp, Homo sapiens
  misc_feature 2, 3: n = A,T,C or G
tnnggaccgggaatgaacccaactgttgaagatgagaaactttttggcaagattaacgatgaggacaaacagaagattctggacaagtgtaatgaaattatcaactggcttgataagaatcagactgctgagaaggaagaatttgaacatcaacagaaagagctggagaaagtttgcaaccccatcatcaccaagctgtaccagagtgcaggaggcatgccaggaggaatgcctgggggatttcctggtggtggagctcctccctctggtggtgcttcctcagggcccaccattgaagaggttgattaagccaaccaagtgtagatgtagcattgttccacacatttaaaacatttgaaggacctaaattcgtagcaaattctgtggcagttttaaaaagttaagctgctatagtaagttactgggcattctcaatacttgaatatggaacatatgcacaggggaaggaaataacattgcactttataaacactgtattg

SEQ ID NO: 57137 - DNA, 498 bp, Homo sapiens
  misc_feature 23: n = A,T,C or G
tgctgagggggcaggcggagctngaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagtt

SEQ ID NO: 57138 - DNA, 500 bp, Homo sapiens
  misc_feature 4, 6, 44, 45, 46: n = A,T,C or G
atangnaccggggaaaaagcaaagtcttgtgatttttaaaggcnnnttttcaagtgctctcatagttctatcctctaattccattaaatccatactaggagcgtcagtgagggttttcatagcttttggaaatactttggtctctgaactgtaattagcaagaagtaaaaacagaaacgtcaaacgtcaaatgtttgctttgttacctggaggactaaatgtagatgtctttagtatactttgtatgttcttaatattggaagataattttgtgaatctgtagattttattttttcagccttaccttacaaatttcttttctatgaataatagaggaacttacggcactctgccatttgttaatgaaaggaagtgcagaggatttagaaaagtacatgatccccagaccacaacaaaccaaaacataaactcatgtctgtgtcccatggtcatagtcaaagattttgtactgctaaaattaccaaataatttaaataaag

SEQ ID NO: 57139 - DNA, 500 bp, Homo sapiens
  misc_feature 40, 378: n = A,T,C or G
aaccggggaaggccttgaggcagcccagcgtaggggcttntgctgagggggcaggcggagcttgaggaaaccgcagaataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttanattaaaatgaaggtgacttaaacagcttaaagtttagtttaaaagttgtaggtgattaaaataatttgaaggcgatcttttaaaaagagattaaaccgaaggtgattaaaagaccttgaaat

SEQ ID NO: 57140 - DNA, 208 bp, Homo sapiens
tctcaccaatgtttgtcatatgcttcttgctttgcatattttttaatctcaaacgtttcaataaaaccatttttcagatataaagagaattacttcaaattgagtaattcagaaaaactcaagatttaagttaaaaagtggtttggacttgggaacaggactttatacctcttttactgtaacaagtactcattaaaggaaattgaat

SEQ ID NO: 57141 - DNA, 500 bp, Homo sapiens
  misc_feature 13, 23, 42: n = A,T,C or G
aagaaccgggggngccctagagnagatctgctgtctcccaantaagcttttgtatctgccagtgaatttactgtactccaaatgattgctttcttttctggtgatatctgtgcttctcataattactgaaagctgcaatattttagtaataccttcgggatcactgtcccccatcttccgtgttagagcaaagtgaagagtttaaaggaggaagaagaaagaactgtcttacaccacttgagctcagacctctaaaccctgtatttcccttatgatgtcccctttttgagacactaatttttaaatacttactagctctgaaatatattgatttttatcacggtattctcagggtgaaattaaaccaactataggcctttttcttgggatgattttctagtcttaaggtttggggacattataaacttgagtacatttgttgtacacaggttgatattccaaattgtatggatgggagggagaggtgtcttaagctgtag

SEQ ID NO: 57142 - DNA, 290 bp, Homo sapiens
  misc_feature 3, 17, 42, 175, 182: n = A,T,C or G
tanggaccgggcgtgtnagaatttaggagacactgtgcactnacatgtttcacaacaggcattccagcaattatgaggcattgaggggatagatgaatactaaatggttgtctgggtcaatactgccttaatgagaacatttacacattctcacaattgtaaagtttcccctctnttttggngaccaatactactgtaaatgtatttggttttttgcagttcacagggtattaatatgctacagtactatgtaaatttaaagaagtcataaacagcatttattaccttgg

SEQ ID NO: 57143 - DNA, 500 bp, Homo sapiens
  misc_feature 2, 6: n = A,T,C or G
anaagnaccgggaaatggccagtgattctaacagtataaagtttacaatattctatgtccctagcctgtcatttttcagctgcatgtaaaaggaggtaggatgaattgatcattataaagatttaactattttatgctgaagtgaccatattttcaaggggtgaaaccatctcgcacacagcaatgaaggtagtcatccatagacttgaaatgagaccacatatggggatgagatccttctagttagcctagtactgctgtactggcctgtatgtacatggggtccttcaactgaggccttgcaagtcaagctggctgtgccatgtttgtagatggggcagaggaatctagaacaatgggaaacttagctatttatattaggtacagctattaaaacaaggtaggaatgaggctagacctttaacttccctaaggcatacttttctagctaccttctgccctgtgtctggcacctacatccttgatgattgttctcttac

SEQ ID NO: 57144 - DNA, 363 bp, Homo sapiens
  misc_feature 25: n = A,T,C or G
ctctttggaccgcaattgaaaaatnaaaccatctggtatctgaagtatcattggccttgaggaagaagacatgctctacagtgctcagtctttgaggtcacgagaagagaatgccttctagatgcaaaatcacctccaaaccagaccacttttcttgacttgcctgttttggccattagctgccttaaacgttaacagcacatttgaatgccttattctacaatgcagcgtgttttcctttgccttttttgcactttggtgaattacgtgcctccataacctgaactgtgccgactccacaaaacgattatgtactcttctttctgccatcttttggaataaatattttcctcctttctatgc

SEQ ID NO: 57145 - DNA, 367 bp, Homo sapiens
  misc_feature 4: n = A,T,C or G
tggnaaaaagtggttctggaaaagcggggaaagggggagcagcctctgggagtgacagtgctgacaagaaggctcaaggtcccaaaggtggtggcaatgcagtaaaggtcagacacattctatgtgaaaaacatggcaaaatcatggaagccatggaaaagttaaagtctgggatgagattcaatgaagtggccgcacagtatagtgaagataaagccaggcaagggggtgacttgggttggatgaccagagggtccatggtgggaccatttcaagaagcagcatttgccttgcctgtaagtgggatggataagcctgtgtttacagacccaccggttaagacaaaatttggatatcatattattat

SEQ ID NO: 57146 - DNA, 488 bp, Homo sapiens
  misc_feature 4, 419, 461: n = A,T,C or G
tttntctgtttgctgggattgggtctgctttttgcctatgcaaggctttttaatcattgtgaatataatagattccttaaaataagaaaattaaaaatcagaaacttcccttggagtagagacatttcagttgcaagcataaagatttttaaatatataacactaggttatataattcatatatgtgtggttttgtattaataatcaaattaataaaaacatttcattttctaccattgtatgaacgtaattttattttttaataaccacactcatagatggttttgattgttccagttgagtgattgtgtatgtacgcataggaatgttttgttcagttgactttgtatttccaataatcagaaatcttacctttatgtataaaaacccattatgtaatgtaaaatgtataatattgnacataatattcagaatacaattattttgggaaattagcttgnatttttaatgtcccaggtgcagtattt

SEQ ID NO: 57147 - DNA, 214 bp, Homo sapiens
  misc_feature 6, 175, 210, 212: n = A,T,C or G
aattanaagtatgcagattatttgcccaaagttgtcctcttcttcagattcagcatttgttctttgccagtctcattttcatcttcttccatggttccacagaagctttgtttctttcaagcagaaaaattaaattgtacctattttgtatatgtgagatgtttaaataaattgngaaaaaaatgaaataaagcatgtttggttttcccnanga

SEQ ID NO: 57148 - DNA, 500 bp, Homo sapiens
  misc_feature 8: n = A,T,C or G
aaccgggngttgcacatcagggagtttaagaaaaccctgcaagtataatgaatttggaaaaaccttttttcaaaaactacaaattataaaacaccaaagtgttcatactaaaatatatttttgcagatacattaaatatgaaagatattcaatccaaaattaagtctatgtaaatatcagggaataattcacagtagaaatatctagggcattcaagctttagacattacactaaatcagagtgctgagtatagaaaataatacaaacagatttgtctaaacatttgtatataactttaaaaatagaatattttttggagggttataattacattcaaagtacttttttttgaaaatacagattttttttaaaagtgaataatgtgttcaactcttaaattcatgctgtttcatcattgctggtgtattcatatgtgaaagcatgtgactaattgttgctgcataaaagatatgagattcttttttattaggcattattt

SEQ ID NO: 57149 - DNA, 500 bp, Homo sapiens
  misc_feature 4, 19, 43: n = A,T,C or G
gtanggaccggggggggcnttcctgaagctgacagcattcgtnccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattgatatgcttatacac

SEQ ID NO: 57150 - DNA, 290 bp, Homo sapiens
  misc_feature 7, 213: n = A,T,C or G
ctatacncttttgcttggttcattttttttccctttagttaagcatgactttagatgggaagcctgtgtatcgtggagaaacaagagaccaacttcttcattccctgcccccaatttcccagactagatttcaagctaattttctttttctgaagcctctaacaaatgatctagttcagaaggaagcaaaatcccttaatctatgtgcaccgntgggaccaatgccttaattaaagaatttaaaaaagttgtaatagagaatatttttggcattcctctaatgttgtgtg

SEQ ID NO: 57151 - DNA, 215 bp, Homo sapiens
  misc_feature 26, 151: n = A,T,C or G
tcagttgagtaccaatgccagaactngtatcaacttgagggtaacaagcgaataacatgtagaaatggacaatggtcagaaccaccaaaatgcttacatccgtgtgtaatatcccgagaaattatggaaaattataacatagcattaaggnggacagccaaacagaagctttattcgagaacaggtgaatcagttgaattttgtgtgtaaacggg

SEQ ID NO: 57152 - DNA, 100 bp, Homo sapiens
gccatactcatttcaagtattatcgacatatgtaatggtgaaaatatatgaactgtggcctttttcattcttgttacttgtgatgcaattaagtgaagat

SEQ ID NO: 57153 - DNA, 329 bp, Homo sapiens
cagtgggaacagcctatttgacacggaatgatatacaagtttgattcacctttgagcactcttagagagtttacagaagaggcgtaactggttacaaaacaaaagttacgccttcactatccagttcttaaagtttatccacatcctacaaatcttatgttcatgtaggtcaggttaaagtaagctccaaacttgtggccttcagaagcatctcctgtttaacacacctgaaattactctaacttaatacatttgtattctctaagaaataatgctgactgctgtcaccacagcatcactgatctctcagtggctgttaaaatataaac

SEQ ID NO: 57154 - DNA, 226 bp, Homo sapiens
  misc_feature 62, 130, 152, 200: n = A,T,C or G
atatgtaataatcgaattcatttaacatgaatcttgagtacgtggaccattgcttgcatgtnaacttttgttttgttttgttttgttttgttttgcatttttaactccagatatcctaaagctcaattgnttggcctctggttttcatcctnagagaagccatggagaacagacttgaaaagtttaggaaatcataatgngggcaggaggggggggggaaaaaaga

SEQ ID NO: 57155 - DNA, 335 bp, Homo sapiens
  misc_feature 26, 238, 256, 309: n = A,T,C or G
tatttaaagcctttttcttattttcngtattaattggtaagtgaaaactctgttaaagatcacaccacaatgttttcaagaaacatctgaaaagataaaacaaagaacaaataacttataatacttacttaaattgacactttttgaaatgccagtctgaaaataattaagatatctctgctttgtatgagtttcttttatgaaacttgataccacgggagtccagtaatattggccncaaaagccagagaaagtnccaagcccagctttgttatcatagccacttcctgccctgcttctgtaattttnagggttttttcagatataaatcgggg

SEQ ID NO: 57156 - DNA, 369 bp, Homo sapiens
  misc_feature 25, 33, 58: n = A,T,C or G
gaaacccaacactcaacaataaagnactgtttntccgttcgcccccatgtgacttttntctgtagcagaaaccaagtctacttcactaatgacgatgccgtgtgtctcgtctcctgacatgtctcacagacgctcctgaagttaggtcattactaaccatagttatttacttgaaagatgggtctccgcacttggaaaggtttcaagacttgatactgcaataaattatggctcttcacctgggcgccaactgctgatcaacgaaatgcttgttgaatcaggggcaaacggagtacagacgtctcaagactgaaacggccccattgcctggtctagtagcggatctcactcagccgcagacaagtaatc

SEQ ID NO: 57157 - DNA, 136 bp, Homo sapiens
  misc_feature 24, 25, 134: n = A,T,C or G
ttaaacttctgatacactagtaanntacaagagaaagctaattttctagctaattctcacccttttaaactcagtagatgtagtagactaatcatacgtttaaaaatattagaaaatccaaataaaaaagacantc

SEQ ID NO: 57158 - DNA, 312 bp, Homo sapiens
  misc_feature 24, 270: n = A,T,C or G
ttgctaaaagttctctaaaatagnctgttttcttaaggaggctaaacccctgtcctacaattttagttattctaccaatttgcttagcaaactatttttaccacaaagaatgaattggttcagctctgttaacaatatattatttttcaattaggtccagatacatgagcttttactccccttattgccagtttctaaagatgcaaacaaatatggaatggaatggtacttttttgctattcaaaatataaccaagaggataaaatttgngttatcattggatggctcccactggatacaatttaaaaaaga

SEQ ID NO: 57159 - DNA, 202 bp, Homo sapiens
  misc_feature 129: n = A,T,C or G
gcggtgtttaaagttatgggtctggatgaaattaactagggagaacgtgtgtattagagaagagaatgggactcaggatcaaatcccaggatcctcaaacattaagaaatgatagagagaggggagatncctacaaaggatgctgggaaggagtaaccactgaaataaaacgaaaaccaggagaatgtgacattagagaagc

SEQ ID NO: 57160 - DNA, 293 bp, Homo sapiens
  misc_feature 17, 23, 268: n = A,T,C or G
aactgtcactgacaagncttgcnacataagtttacagtaatagtctttaaaagaacaaataattttcacataaaacacctaaaaattattacttcttttgggctactacaaaaatacagtaaactgggtggctcataaaccacagaaatgtatttctcacagttctgaagccagagaagttcacgatctaggtactggcagattctgcgtctagttagggccactttctgattcatagacgatgccttcttgtgtgtcctcacatagnggaaggggtgaatgagttctctttg

SEQ ID NO: 57161 - DNA, 222 bp, Homo sapiens
  misc_feature 24, 59, 156, 184: n = A,T,C or G
cggcagtgatgaagaggagacagncagtccttcagaagatggcatgcagagtgcacgcncccaggcacgcccaagagagcccctggaggatggtgacccagaggatgacaggacgcttgatgatgatgagctggctgagtacgacttatataaatntgatgaggaaggtgacccagatgctganactcttggggaatctctcttgggtcttacgggctacgg

SEQ ID NO: 57162 - DNA, 245 bp, Homo sapiens
  misc_feature 24, 25: n = A,T,C or G
tcttgcatgcgagggaccattgcnnggcccacaaactctttaacaacttgaaataaatgtgtggacttaattcaccccagtcttcatcatctgggcatcagaatatttccttatggttttggatgtaccatttgtttcttatttgtgtaactgtaagttcacatgaacctcatgggtttggcttaggctggtagcttctatgtaattcgcaatgattccatctaaataaaagttctatgatctta

SEQ ID NO: 57163 - DNA, 203 bp, Homo sapiens
  misc_feature 20, 26, 152, 177, 185: n = A,T,C or G
gaccaaactgattccaaggnaacacngtggtgcctaccaagaagtctcagatcttttctacagcttctgataatcaaccaactgttacaatcaaggtctatgaaggtgaaagacccctgacaaaagacaatcatcttctgggtacattttgntctgactggaattcctcctgctccncggggggncccacagattgaagtcac

SEQ ID NO: 57164 - DNA, 266 bp, Homo sapiens
  misc_feature 17, 22, 174, 177, 214, 258, 265: n = A,T,C or G
gcggtggtgttcgtctnctccnctcctcgattgttgcgcgctcatcttcctctcggtctacttcataattacattgtctgatttagaatgtgattacattaatgctagatcatgttgctcaaaattaaacaagtgggtaattccagaattgattggccataccattgtcactgnatnactgctcatgtcattgcactggttcatcttccttctnaacttacctgttgccacttggaatatatatcgatacattatggngccgagng

SEQ ID NO: 57165 - DNA, 213 bp, Homo sapiens
  misc_feature 27, 183: n = A,T,C or G
ttctgaagaagcagcgtaccaagaaanaataaagaagaggctgcagaatatgctaaacttttggccaagagaatgaaggaggctaaggaggagcgccaggaacaaattgcgaagagacgcagactttcctctctgcgagcttctactttctaagtctgaatccagtcagaaataagatttttntgagtaacaaataaataagatcagactctg

SEQ ID NO: 57166 - DNA, 233 bp, Homo sapiens
  misc_feature 81, 178, 199, 229, 233: n = A,T,C or G
aaacaggaacctgtacagaaagtgccctggaagaaggcctgctctaaattatccagtgtatggagaaacgacacaggttanggagacgtcgctttgaacgtgctataggaccttctcaaacacacaccatcagaattcaatattcacctgccagactggcttatcaagacaaaggggnccttcataatgaagttaaagngagtatactggggagaggacttccaaatgnggcn

SEQ ID NO: 57167 - DNA, 198 bp, Homo sapiens
  misc_feature 155: n = A,T,C or G
aatttttgtatttttagcagagacggggtttcaccacattggccaggatggtctcgatctcaacctcgtgatccacccacctcggtctcccaaagcgctgggattacagggcgtgagccacccgcgccaagccaaggtctgcattttttctttanaactcaaaaacacccaatagtcctaggcccccatcctcgcatg

SEQ ID NO: 57168 - DNA, 269 bp, Homo sapiens
  misc_feature 24, 176, 177, 178: n = A,T,C or G
gaatgcagttattaagtcaaaggnccaatgtgcaattgatatgtttttagatgagagagaaaaattaaagctaaaattagctgcaaagaagtattaataatcacctctgcaaaaattctaagttgccaactggcaaagaaagtctaatgttaaaaacaactttgcctttgaaacgnnnataaatggatttactttgctaagaattatggcaagtgtcaaaaatagtatctgaagacctgaatcatcatgaaatgaacctctacttctgg

SEQ ID NO: 57169 - DNA, 166 bp, Homo sapiens
  misc_feature 2, 3, 121, 154: n = A,T,C or G
annatccgatgttatttttctcttatgtatctgtaaagatttttggcatatgaatgtaatattaaagtcaatgatgctataacttgcgatgtttgcatcatgtcaacctttttgaaggagngaaaaagccttactatgtttttaaatagcaagngggggcgcaggg

SEQ ID NO: 57170 - DNA, 143 bp, Homo sapiens
  misc_feature 25: n = A,T,C or G
tgtatatctcaacagaaaaaaccgnctagcttggtggtatttttatagccataaaagaaaatctttaggctttcaaaataaggatgactttagaataatattgtgtcatagaattaattttcagccatgtggaccatattttg

SEQ ID NO: 57171 - DNA, 168 bp, Homo sapiens
  misc_feature 74, 147, 149: n = A,T,C or G
ccttgttgccactttgggtattctgagattttctcttgcatgcccttagctttacagcttttgcatttcctgtnggatttattctcagccattttgggcatatgtatctttataatcagactggaaacgggactttctattaatatngnggggagaataaaaaatagg

SEQ ID NO: 57172 - DNA, 144 bp, Homo sapiens
  misc_feature 14, 19: n = A,T,C or G
gctaatgtactttnacttnccaactctagatcagaaattgttgacttgcattcagaacataaatgcacaaaatctgtacatgtctcccatcagaaagattcattggcatgccacaggggattctcctccttcatcctgtaaagg

SEQ ID NO: 57173 - DNA, 224 bp, Homo sapiens
  misc_feature 20, 22, 150, 173: n = A,T,C or G
tgtgcaaatgccttcttgcngncctgtcggtctcagtacgttcactttatagctgctggcaatatcgaaggttccttttttgtttgtgtaaactctaatttctatcaaggtgtcatggatttttaaaattagtatttcattacaaatgtntcagcattggttaactaattttngccagggaccattattgatcaagcaaataaattcaacagccatttggcaga

SEQ ID NO: 57174 - DNA, 116 bp, Homo sapiens
  misc_feature 17, 21: n = A,T,C or G
taaataggggaaggctnatancctcattatttaacaaattcccctgaacatctaggcagccatggatttctcaaaccaactctcagatatacagtgttgtgtagagttagctccat

SEQ ID NO: 57175 - DNA, 114 bp, Homo sapiens
  misc_feature 36, 80, 81: n = A,T,C or G
atactgatattttagaactgtttacatttcttctgnttatttttgaattttcagtttgatatcttgtccttattcattgnnggataaacaactgtactttaatttcaagtagta

SEQ ID NO: 57176 - DNA, 129 bp, Homo sapiens
  misc_feature 22, 27, 28, 29, 30, 32, 40, 42, 53, 55, 57, 58, 62, 66, 67,70, 71, 72, 74, 75, 80, 82, 83, 89, 90, 91, 100, 107, 112,126: n = A,T,C or G
cgcaaaaaaaaaaaaaaaaaanaaaannnncntggggggncncccgggcccantncnntttnaaannggnnnannttttngnngggggnnnaaatttggnccccctngggcnaatccccccttttnggg

SEQ ID NO: 57177 - DNA, 103 bp, Homo sapiens
  misc_feature 100: n = A,T,C or G
taagactaaagtggccgttgatgagaataaagccaaagaattccttggcagcctgaagcgccagaaagcggcagctgtgggaccggactcggcccgaggngca

SEQ ID NO: 57178 - DNA, 169 bp, Homo sapiens
  misc_feature 118, 146, 147: n = A,T,C or G
aaaatcaaaccgagcagggctgtgtgaaacatggttgtaatatgcgactgcaaacactgaactctacgccactccacaaatgatgttttcaggtgtcatggactgttgccaccatgtnttcatccagagttcttaaagtttaaagnngcccatgattgtataagcatgc

SEQ ID NO: 57179 - DNA, 156 bp, Homo sapiens
  misc_feature 87, 150, 151, 155: n = A,T,C or G
cctaacaattcgttgtgtggacttctcatctaaaaggttagtggcttttgcttgggatcagtgctctctattgatgttcttgctggnctccagacacattcctgttgcattaagacttgaaagacttgtagatgtgtgatgttcaggcgnnggang

SEQ ID NO: 57180 - DNA, 245 bp, Homo sapiens
  misc_feature 25, 149, 174, 234: n = A,T,C or G
gaacaaccagaaaatggttttccgncagttcctggtagaagacaaaggactttacggaggctcttcttatgtggatttcctttgttgtgttcacaaggagatctgtcagctgcttaattaattgaaacttctctgtcattgatgttgcntttccaaggagataatctccttctnggggcctaattttctagatgataataggctagttttgatttcttgctcattttcaaaaanacctttccagg

SEQ ID NO: 57181 - DNA, 145 bp, Homo sapiens
  misc_feature 19, 23, 76: n = A,T,C or G
ctatcatgaggggagagcnaacnaagaaattctcctaggaagagctcatggcccagtacatcctagtaattatttnaattagtttttgttctgacagcttgtcagggaagggcacagaatgggacagagataaaacccaggacag

SEQ ID NO: 57182 - DNA, 157 bp, Homo sapiens
  misc_feature 74, 75, 120, 134, 146: n = A,T,C or G
aaaccgcagataagtttttttctctttgaaagatagagattaatacaactacttaaaaaatatagtcaataggnnactaagatattgcttagcgttaagtttttaacgtaattttaatantttaagattttaanagaaaatatgangggggggaaga

SEQ ID NO: 57183 - DNA, 186 bp, Homo sapiens
  misc_feature 24, 148, 175: n = A,T,C or G
gccaagaaacatttggatgccccnccagctgaattgcttttagcccagactgaagactatgtggagtactcaagacatgggacagtcatcaaaggacaggagcgggctgttgcctgctctaagtatgaggaggatgtgaagatccacnttcacacacatatctggggatcgtacngggaaagaagg

SEQ ID NO: 57184 - DNA, 122 bp, Homo sapiens
  misc_feature 88, 110, 121: n = A,T,C or G
tataaagtgctaaactgcatatcatagaataaatgatccgagagtttagatgaggcaaataacagagtaatcaaaaatggcttcaggnagtcgggaaaatttgaacaggnagaatcagctnt

SEQ ID NO: 57185 - DNA, 128 bp, Homo sapiens
  misc_feature 17, 21: n = A,T,C or G
ctgtgcaagattctggnatgncggttgtggtggaaacaaaaacaaatttggatcacagaaagaatgtgaaaaggtttgcgctcctgtgctcgccaaacccggagtcatcagtgtgatgggaacctaag

SEQ ID NO: 57186 - DNA, 122 bp, Homo sapiens
  misc_feature 24, 99: n = A,T,C or G
aaggctgccccctgccccagggcncttcagaaagcatctgcatgtgaacaccatcatgcctttataaaggatccttattacaggaaaagcatgagtggnggctaacctgaccaataaagtta

SEQ ID NO: 57187 - DNA, 177 bp, Homo sapiens
  misc_feature 3, 123, 146: n = A,T,C or G
acntgaaatcaatcaaagggaaacttgaagaacagagaccagaaagagtaaaaccttttatgacaggggctgcagaacaaatcaagcacatccttgctaatttcaaaaactaccagttctttnttggtgaaaacatgaatccaganggggggggggctctattggactaccgggagg

SEQ ID NO: 57188 - DNA, 199 bp, Homo sapiens
  misc_feature 21, 147, 178: n = A,T,C or G
tttgttgcattgtccgatgtntccgatgtaccaactgcaaaaattatttccagagaagtatctgatggtataattgccccaggatatgaagaagaagccttgacaatactttccaaaaagaaaaatggaaactattgtgtccttcanatggaccaatcttacaaaccaggatgaaagnggggttcgaactctctttggg

SEQ ID NO: 57189 - DNA, 179 bp, Homo sapiens
  misc_feature 123, 124: n = A,T,C or G
aatatttttaatcatcttaaagtatgatttgatataatcttattgaaattaccttatcatgtcttagagcccgtctttatgtttaaaactaatttcttaaaataaagccttcagtaaatgttnnttaccaacttgataaatgctactcagggggagctggtttggggctatagcatatg

SEQ ID NO: 57190 - DNA, 117 bp, Homo sapiens
  misc_feature 51, 84: n = A,T,C or G
gcggaatggaaatgtgggcaagactgtctttgaatatagaacacagaatgnggcacgcttgcccatcatagatcttgctcctgnggatgttggcggcacagaccaggaattcggcgt

SEQ ID NO: 57191 - DNA, 157 bp, Homo sapiens
  misc_feature 30, 83, 86, 97, 121, 145, 155: n = A,T,C or G
tcaagtaagtatccagaagcctagaaaggnttgtctgaaatgagccccaattctgaactttctggatattagtctttcctggngtnattattaaggngaaatgaaatattctgctttgtgngtacctacaaaccagaaattagangggggggggngg

SEQ ID NO: 57192 - DNA, 204 bp, Homo sapiens
  misc_feature 27, 58, 63, 81, 120, 148, 152, 188, 192, 196: n = A,T,C or G
gtgttttgtaatatataaataaaccgngtgctgcatgccacacttatctatattctgncgggngttacataactttttggngtacttaattcaatgaacaataagtcaacttggaaagcntaaaaaggcgagatatcataaagaaggngggngacagaagatagtattgcacctgcttttgatagctnctgngttnccagaaac

SEQ ID NO: 57193 - DNA, 100 bp, Homo sapiens
  misc_feature 99: n = A,T,C or G
ctatagttcttaaatgtggctaattctgtaacatagtcttggtattttttaattatgaatgcatatcctatttccaggcaggctctcttacttgaacana

SEQ ID NO: 57194 - DNA, 120 bp, Homo sapiens
  misc_feature 3: n = A,T,C or G
gangtgaatgtggttggtctctcttgctttcaaaatatcttcttgtacagtactcacctattttagaatgtggttgactacaggtaaccaaaaccacagaaagggaaactttggatgagg

SEQ ID NO: 57195 - DNA, 120 bp, Homo sapiens
gaagcagctacccgaatacctgcttagttcctgaaaaggggagtgtaactagtggatttgggaaaggttcttaagtagatcctgagactatttgcatgcttctgtctaaaatgataatta

SEQ ID NO: 57196 - DNA, 269 bp, Homo sapiens
  misc_feature 166, 177, 180, 208, 234, 238: n = A,T,C or G
catggaaaatgcattgtcagaaaccgaaacgagttggctgagactcttgcactcctgaaagcacaaattgatcctgtactattgaaaaactctagccaacaagacaactcttctcgggaaagtcccagcttagaggatgaggagactataaaaagaggaagaaacncctaaacaggnggngcagaaagaaagtgaaaagatgaaaagngaggagcagcctatggatttagaaanccgncctacagccaatgttctagaagagactactg

SEQ ID NO: 57197 - DNA, 240 bp, Homo sapiens
  misc_feature 2, 22, 147, 177, 232, 235: n = A,T,C or G
gngacaagcatgccagaagagnccggggccatcagggctaaccacttcacacctaccatcgtcccatggggatccaagacctgagataaagcaacagcctgcccagatccctctgttcatcctatcccttccaaggttggtccattncaacataacctctgggcatcagacatgagnaggtctgtgtgcctcagccctgttaaggggcaggtttctctttagccctcttccngcncttgg

SEQ ID NO: 57198 - DNA, 142 bp, Homo sapiens
  misc_feature 22: n = A,T,C or G
gcatttttaaatcccagaagcngatatgacccacactgccagaagagaattcagtattttttacttttcacactgtcttcccgatgagggaaggagcccagccagaaagcactacaatcatggtcaagttcccaactgagtc

SEQ ID NO: 57199 - DNA, 277 bp, Homo sapiens
  misc_feature 25, 173, 209, 232: n = A,T,C or G
aatggaattgttcatattcaccagngtagtgcttttgtactaaaaagtagactacgtatagggtaggtagacaatcttcttaaactgctttgaaaatactgactctaattgataggttattttccagagaaattgggggaaatagtctcctttggtattgactccccaaacangcacagtttggatggaaacgctgttgtactggctgngagatgctgacccttggcagacncatttgtttcttaattttctactcaaaaggctactaactttgcga

SEQ ID NO: 57200 - DNA, 116 bp, Homo sapiens
cccagcttgggggcccagaagctgcaaaatccgatgagactgccgccaagtaaagccttagcccggatgcccacccctgctgccgccactggctgtgcctcccccgccacctgtgt

SEQ ID NO: 57201 - DNA, 256 bp, Homo sapiens
  misc_feature 17, 24, 98, 114, 167, 175, 223, 233: n = A,T,C or G
cctgaccagcagaggtngatctcngctgggaaacagctggaagatggacgcaccctgtctgactacaacatccagaaagagtccaccctgcacctggngctccgtctcagaggngggatgcagatcttcgtgaagaccctgactggtaagaccatcaccctcgaggnggagccgngggacaccatcgagaatgtcaaggcaaagatccaagataaggaaggcntccctcctgnccagcagaggttgatctttgctg

SEQ ID NO: 57202 - DNA, 144 bp, Homo sapiens
  misc_feature 4, 6, 29: n = A,T,C or G
tttntncaagcatcaccctggggagccgnctgaggggtttctcataaatgagggctgacattgcctgttctgcttcgaagtattcaataccgctcagtattttaaatgaagtgattctaagatttggtttgggatcaataggaa

SEQ ID NO: 57203 - DNA, 192 bp, Homo sapiens
  misc_feature 70, 147, 149, 150: n = A,T,C or G
catgagcaaagctcaccctcccgagttgaaaaaatttatggacaagaagttatcattgaaattaaatggnggcagacatgtccaaggaatattgcggggatttgatccctttatgaaccttgtgatagatgaatgtgtggagatggngnnggggggacaacagaacaatattggaatggggggaatacgagg

SEQ ID NO: 57204 - DNA, 296 bp, Homo sapiens
  misc_feature 2, 4, 127, 154, 210, 212, 214, 290, 293: n = A,T,C or G
cncnccgccaatttctctcagatttccacagagactgtttgaatgttttcaaaaccaagtatcacactttaatgtacatgggccgcaccataatgagatgtgagccttgtgcatgtgggggaggatngagagagatgtactttttaaatcatgngccccctaaacatggctgttaacccactgcatgcagaaacttggatgtcactgccngncntccacttccagagaggacctatcccaaatggggaattgactgcctatgccaagtccctggaaaaggagcttcagtnttnggg

SEQ ID NO: 57205 - DNA, 242 bp, Homo sapiens
  misc_feature 18, 20, 25, 159, 174, 176, 234: n = A,T,C or G
aaaaccattcactgtatnantaccncatttctcctgattcagatatttttagtaatttgcttatatgtaaaagttgtttttgtggagtcagtggatatatttctaatgaagtgctagactatccaattacttaatttcttatacctttagataatcagnatgaaaagttcccangnataatggaaatgaaaattcttaactaaactatacatgtaatatgtatttctagaaganaataaaaa

SEQ ID NO: 57206 - DNA, 177 bp, Homo sapiens
  misc_feature 150, 165, 175: n = A,T,C or G
gtagagaggctggtcttgaactccttgcctcaagtgatccactagacttgacctcccagagtgttgggattacaggcatgagccaccatgcctggccagtgttatatgtcctaatagaagtttgggttatgttgggcgaattcatttatnggaacttacccaagngtacacttgngc

SEQ ID NO: 57207 - DNA, 100 bp, Homo sapiens
  misc_feature 27, 85: n = A,T,C or G
ggctcacgcctgtaatcccaccatttngacaggccaagttgggcagattgcctgacctcaggagttccagactgggcaacacggngaaacccatctctat

SEQ ID NO: 57208 - DNA, 216 bp, Homo sapiens
  misc_feature 100, 102, 106, 124, 155, 192, 210, 213: n = A,T,C or G
ccatggcgtaccgtggccagggtcagaaagtgcagaaggttatggtgcagcccatcaacctcatcttcagatacttacaaaatagatcgcggattcaggngnggcntttatgagcaagtgaatntgcggatagaaggctgtatcattgggggggnggagtatatgaaccttggattagatgatgcagaaganattcattctaaaacaaanccnaga

SEQ ID NO: 57209 - DNA, 232 bp, Homo sapiens
  misc_feature 17, 20, 136, 139, 174, 178, 179, 229, 230, 231: n = A,T,C or G
atagcagttaccccaangcnccgggactaatggcatcagggcaaaaatatgttactttacgatttacctgttagcaggttcttgtttcataaaggtagaaaataaatacagacaacatctactgagctagttgatnggngatgcttctaccttaatatctttcctactgagggngaanncctttattttcacatatactaaaactttttaaatgcatgttaattcagannnc

SEQ ID NO: 57210 - DNA, 271 bp, Homo sapiens
  misc_feature 22, 173, 176, 179, 228, 231: n = A,T,C or G
tgatgctttagtgcaggccagncccgaggcaataacaagttgccgtgaaaacagcatgtgctgctgcctttgtaactgcatggaaacttttcacatgggtttttctccaagttaatacagaaatatgtaagctgagagatgcaaatgtaatatttttaacagttcatgaaggnggngtnaaaataaccaacataaaacttaattactttaatattatataattatagnagnggccttgttttacaaacctttaaattacattttagaaatc

SEQ ID NO: 57211 - DNA, 236 bp, Homo sapiens
  misc_feature 23, 175, 176, 179, 211, 222: n = A,T,C or G
tggtatagacgctgtggaaaacnccgtggcagttcctcaaaaaattaaacacagaattaccatgtgattaagaaattccattttgcatatgtaccccaaagaaatgaaagcagggtctcaaagaggtatttgtaaacctgtgttcacagcagcagcattcacaatagctaaaacnnggnagctcaagtatgcatcaagagatgaggggatncgcaaaatggngtgtacatacaacg

SEQ ID NO: 57212 - DNA, 236 bp, Homo sapiens
  misc_feature 22, 23, 173, 177, 216, 217, 233: n = A,T,C or G
ccactaccccacaccagcctcnnggccaccaaaagtgctccccaaaaggaaggagaatgggatttttcttttgaggcatgcacatctggaattaaggtcaaactaattctcacatccctctaaactactgttaggaacagcagtgttctcacagtgtggggcagccgtccttngaangaaagacaatgatattgacactgtccctctttggcagtnncattagtaactttgancgg

SEQ ID NO: 57213 - DNA, 131 bp, Homo sapiens
  misc_feature 21, 23: n = A,T,C or G
gaaaagaactgcttgcataancnccatttctgtctcataattgtcaaaaaccagaattaggtcaagttcatagtttctgtaattggcttttgaatcaaagaatagggagacaatctaaaaaatatcttagg

SEQ ID NO: 57214 - DNA, 166 bp, Homo sapiens
gaaattgaagttggtggtggtcggaaagctatcataatctttgttcccgttcctcaactgaaatctttccagaaaatccaagtccggctagtacgcgaattggagaaaaagttcagtgggaagcatgtcgtctttatcgctcagaggagaattctgcctaagccaa

SEQ ID NO: 57215 - DNA, 115 bp, Homo sapiens
gttagaatgaggaggtctgccgctaggagtcaataaagtgattggcttagtgggcgaaatattatgctttgttgtttggatatatggaggatggggattattgctaggatgagga

SEQ ID NO: 57216 - DNA, 208 bp, Homo sapiens
  misc_feature 26: n = A,T,C or G
taaattccaaacctcaaaaactatcntggcctgagcagctgaaatctagcagagtttaactcttctgcctccatgtctgtcacttataattcaggttctgctgttggcttcagaacatgagcagaagaatcgttttatgctagttattgcattcatggttgaaactcaacttagggaaagggttccaatgtattaagcaatgggctgc

SEQ ID NO: 57217 - DNA, 142 bp, Homo sapiens
  misc_feature 20: n = A,T,C or G
ggcctggtggctaggaaggncccctcctttccagtcggagacctctgccgcaaacatgctccgtcagatcatcggtcaggccaagaagcatccgagcttgatccccctctttgtatttattggaactggagctactggagca

SEQ ID NO: 57218 - DNA, 119 bp, Homo sapiens
  misc_feature 2: n = A,T,C or G
gnagctggttgacatctttccctaaatcgatccatgttaccacatagtagttttagtttaggattcagtaacagtgaagtgtttactatgtgcaacgggtattgaagttcttatgacca

SEQ ID NO: 57219 - DNA, 160 bp, Homo sapiens
  misc_feature 2, 150: n = A,T,C or G
gnggcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaangggaatgagg

SEQ ID NO: 57220 - DNA, 250 bp, Homo sapiens
  misc_feature 20, 22, 229: n = A,T,C or G
tttactggtaaattatgttncnttttacaactaattttgtactctcagaatgtttgtcatatgcttcttgcaatgcatattttttaatctcaaacgtttcaataaaaccatttttcagatataaagagaattacttcaaattgagtaattcagaaaaactcaagatttaagttaaaaagtggtttggacttgggaacaggactttatacctcttttactgtaacaagtnctcattaaaggaaattgaatg

SEQ ID NO: 57221 - DNA, 120 bp, Homo sapiens
  misc_feature 3: n = A,T,C or G
ganattcatataggaagagaggaagctaaattgtctctgtttgcagatgacatgattgtatatttagaaaaccccatcatctcaccccaaaactccttaagctgataaacaacttcagta

SEQ ID NO: 57222 - DNA, 246 bp, Homo sapiens
  misc_feature 2, 24, 175, 178, 179, 232: n = A,T,C or G
antcacgagttgtacatagctccnatttaggtttgacctcagtcccaaccaacattccatttgatactcgaatgcttgatcttcaaaacaataaaattaaggaaatcaaagaaaatgattttaaaggactcacttcactttatggtctgatcctgaacaacaacaagctaacganganncacccaaaagcctttctaaccacaaagaagttgcgaaggctgtatctgtcccnccccaactaagtga

SEQ ID NO: 57223 - DNA, 149 bp, Homo sapiens
  misc_feature 18, 23, 146: n = A,T,C or G
tggtgcatcctgggccgnattcnaactttcaagggtcctaggcccttttgcctgcatgggtcccttcctccattcaaaaaaaaagttaaaaattatattttacaactgcattagtataaagacaaatataatccaaaaaaaaaaanttt

SEQ ID NO: 57224 - DNA, 215 bp, Homo sapiens
acatcaaaaaatatgaaagattttaaataaataacctagtgttacacctcaaagaactagaaaaggaagaacaaactaagaccaaagtcagcataggaatgaaataataaagatccgagcagaaatacatagagactagaaaaataatagaaaagatcaatgaagagttgcacttttgaaaaacaaacaaaataatgcaaacctttagctagagt

SEQ ID NO: 57225 - DNA, 489 bp, Homo sapiens
gactgtggggagtgagggaatgagaggagttaaggatgaccccacagtttttgggctgagcagctggaatggcagagatgacatttactatttatcaggatgaggaagattacaggaggagcaggttttagggagagatcagtgaaggtgcgagcaactgagattccaactagatatccaaaggtaacatagacagaagacagtggatatacaatagtaattatttaaacgttcattttgcacaagttgataaatcacaaaagttctgtttaaatgatttaaatcttcatgaagatgttgctataattcacattttatagattaggaaataatgcagaaggattaatattcctaagatcactgatatgaaactattttatgactaagttccaggttgttctactgactttattatattataaaataggcatataagggaaattttcattattgccataattgagcaagtaatacttcttgttgccttta

SEQ ID NO: 57226 - DNA, 280 bp, Homo sapiens
caccatctgagcggcatctccttcatttcctccatgtttctcttcttttctttgttgccgcttttctccatcgcactattctcagtgggaatggaggactcagctctttagtcccatcatttgtacagaaatttttagctttctgtgaaataaaatttcctcccatctctgtaagctccccactcctttctctctttagtatgtcttaactcttttgatttcttatgtccttaatttattgtcgagaagcttgaataaaatccaaaaaaagctccttctc

SEQ ID NO: 57227 - DNA, 471 bp, Homo sapiens
acacctcgcagtcattcctgcggcttgcgcgcccttgtagacagccggggccttcgtgagaccggtgcaggcctggggtagtctcctgtctggacagagaagagaaaaatgcaggacactggctcagtagtgcctttgcattggtttggctttggctacgcagcactggttgcttctggtgggatcattggctatgtaaaagcaggcagcgtgccgtccctggctgcagggctgctctttggcagtctagccggcctgggtgcttaccagctgtctcaggatccaaggaacgtttgggttttcctagctacatctggtaccttggctggcattatgggaatgaggttctaccactctggaaaattcatgcctgcaggtttaattgcaggtgccagtttgctgatggtcgccaaagttggagttagtatgttcaacagaccccattagcagaagtcatgttccagcttagac

SEQ ID NO: 57228 - DNA, 293 bp, Homo sapiens
tgcaaagatttactgtaaagtagatttctttccctccctcccccattcttttattgtaaatattgtctctaaatgtgtaacatattataaagaatttataaggatttttaaagatgttttgctcatttacaaaagtgttgtaacagtgttggacaaagccttccaccccatgtccgcatggctcctttcactgtgtccttgacacacctctctggcaacaactaaaatttcctgcttctgaaaagtcctgtcttaaaagtacagtctatatcttggaaataaatagctttccg

SEQ ID NO: 57229 - DNA, 442 bp, Homo sapiens
caaggatcacaataaacaggattgaactttgtaaacaaccaaagtcaggggccttcagaactgcaattcttactccctttcacagactgtccggagtctttgggtttgattcacctgctgcgaaaaacattcaacaaattgtgtacaagataaattaatctcactatgaagatttgaataactagacattatttatgctgccaaactcatttgttgcagttgtttgtaatgtctagtggggcttcatcatcctgaaaagaaggagacagggatttttttaaagagcaagaaagtcacaatattacttctttccttcctttttccttctttcctttcttctttctctttctttctttttaaaatatatttgaagacaaccagatatgtatttgctactcaagtgtacagatctcctcaagaaacatcaagggactcctgtgcc

SEQ ID NO: 57230 - DNA, 474 bp, Homo sapiens
  misc_feature 10: n = A,T,C or G
gatatcaagnaagcttccttacattagtagcaataaatattagaataaatatgaaattgaactattttcagaaaaagggcagtatattaagagcagggactgttctctagttattgaggaaaactggactttgtttgtgtttttggtggaggaagaagtttaagatactttagtcttaaattgaggtttgccaaatgagaagttcaaaaacttgggctttctaatcagaatttccaggaggaggaaagtgtgtgctgaatattttaaacatttcccactgatcatacaaagtctgatttttaaatttacacttataatgcctttgtattaaaattatttttaacatgtgcttttccaaattaaaaatgaagtagagtataccaaatgcataaactttcattagctaaggaactcatgtctgaattttgttgtagttttgaatgttgtgctctttcatacagaacgggaaacata

SEQ ID NO: 57231 - DNA, 116 bp, Homo sapiens
cttctaattttgattgagaaacttgctttgaaggcaggttcatcaaagcagggaaaggccattctagctgcagtgggttcaaattgtgttgatgctagtatcctaaaattaaggcg

SEQ ID NO: 57232 - DNA, 449 bp, Homo sapiens
  misc_feature 9: n = A,T,C or G
atcacaagnaacacacacatatacacgaatagacatcaaactcaatgctttatttgtaaatttagtgtttttttatttctactgtcaaatgatgtgcaaaaccttttactggttgcatggaaatcagccaagttttataatccttaaatcttaatgttcctcaaagcttggattaaatacatatggatgttactctcttgcaccaaattatcttgatacattcaaatttgtctggttaaaaaataggtggtagatattgaggccaagaatattgcaaaatacatgaagcttcatgcacttaaagaagtatttttagaataagaatttgcatacttacctagtgaaacttttctagaattatttttcactctaagtcatgtatgtttctctttgattatttgcatgttatgtttaataagctactagcaaaataaaacatagcaaatggc

SEQ ID NO: 57233 - DNA, 474 bp, Homo sapiens
catttggaaaacaataaactaaaaaaaatcccttcaggattaccagagttgaaatacctccagataatcttccttcattctaattcaattgcaagagtgggagtaaatgacttctgtccaacagtgccaaagatgaagaaatctttatacagtgcaataagtttattcaacaacccggtgaaatactgggaaatgcaacctgcaacatttcgttgtgttttgagcagaatgagtgttcagcttgggaactttggaatgtaataattagtaattggtaatgtccatttaatataagattcaaaaatccctacatttggaatacttgaactctattaataatggtagtattatatatacaagcaaatatctattctcaagtggtaagtccactgacttattttatgacaagaaatttcaacggaattttgccaaactattgatacataagggttgagagaaacaagcatctattgc

SEQ ID NO: 57234 - DNA, 288 bp, Homo sapiens
  misc_feature 250: n = A,T,C or G
atgaaagcagtattttctgtgtttcctttttaatttacagcctttttcttaatttttttggtatttttttaaacgttcgtggatgaatgccaactttcagacggagcccacttagcttgtccacatgtatctcaatgccaaccctccatttttcctctccagatatttttgggagtgacaaacattctctcatcatacttagcctacctagatttctcacgacgagtaatgcatgtccgtggttggggtngccaccctgtagttctgtttattggtcagtggaaacga

SEQ ID NO: 57235 - DNA, 251 bp, Homo sapiens
  misc_feature 27: n = A,T,C or G
gtggaacaataacaacagactaaggcnaaattaggcagaaagagggaattaacaaagatttgagcagaaatacatgaaacggaaaattcaaaaataatagaaaaaaataagacaactaggaattggttttactggttttttataaatataaactaaattggtaaaaccttaagtaaactaactagcaaaaaaagagcgatgcctcaaataaaaaaatcagaaatgaaagaagagaaatcacaaatgatgcc

SEQ ID NO: 57236 - DNA, 231 bp, Homo sapiens
agaaagtgggaaagatctaaaatcaacatgctaacatcacaattaaaagaaatagagaagcaagagcaaacaaactgaaaagctagcagaagacaagaaataactaagatgagagcagaactgaaggagacagagacacgaaaaacccttcaaaaaaatcaatgaatccaggagctggtttttttgaaaagattaacaaagtagatagaccactagccagactaataaaga

SEQ ID NO: 57237 - DNA, 491 bp, Homo sapiens
  misc_feature 5, 7, 34, 35, 185, 187, 188: n = A,T,C or G
gaaancnagtacctgtactgcaaaggctggtttnnataccttatccttcaatgcccagcatactgacaaacatcaacagtatcaataacattgaagccaatatgacctcaacaaatggaccaagtaaggcactcagtgaccaaccctggagagatggagacgtgtaactctcagggaattcagantnnctattttgagaaagctcaatgaacttcaagaaaacacagagaaacaattcagaaatatatcagaaatttaacaagattactgaagtaagagaaaaaaatcaaatgctggagctggaaaatgcattagtgggtctcagtagaattgatcaagcagaagaaagaattagtgagcatgcaaacaagctatttgaaaatagaggagaaaaaagaaaagaagaatgagcaggaacacagaatgcttaagagatctagaagagggcctgaaaagagaaaatcaaagattcattggccttaaagagggag

SEQ ID NO: 57238 - DNA, 468 bp, Homo sapiens
atcatgggctggtatttgtaaaagacaagatatttgctgtgggtggtcagaatggtttaggtggtctggacaatgtggaatattacgatattaagttgaacgaatggaagatggtcccaccaatgccatggaagggtgtaacagtgaaatgtgcagcagttggctctatagtttatgtcttggctggttttcagggtgttggtcgattaggacacattctcgaatataataccgaaacagacaaatgggttgccaactccaaagttcgtgcttttccagtcacaagttgtttaatttgtgttgtcgatacttgtggagcaaatgaagagacccttgaaacatgaaaaatgagtggacttcagactcatcagagactctaaaatatagccaccagtgctttgttccaggagtttggtgacaaagttttggtttggtgttttggtaaagaaagtttcaagtgaaatgagg

SEQ ID NO: 57239 - DNA, 423 bp, Homo sapiens
atcccaatagctgttgcccattgacctctagtggtgagtttctagaatactggtccattcatgagatattcaagattcaagagtattctcacttctgggttatcagcataaactggaatgtagtgtcagaggatactgtggcttgttttgtttatgtttttttttcttattcaagaaaaaagaccaaggaataacattctgtagttcctaaaaatactgacttttttcactactatacataaagggaaagttttattcttttatggaacacttcagttgtactcatgtattaaaataggaatgtgaatgctatatactctttttatatcaaaagtctcaagcacttatttttattctatgcattgtttgtcttttacataaataaaatgtttattagattgaataaagcaaaatactcaggtg

SEQ ID NO: 57240 - DNA, 149 bp, Homo sapiens
catctagcagaggttggcctctggctctgacactttttgtcagttgtctttaggtggtcctgaatcttgggcccttttgattgtgaatactgtgtagcaggatcttgagagtccttgttcttacataggcattgctctagtttgtcttt

SEQ ID NO: 57241 - DNA, 422 bp, Homo sapiens
gaacacaatccgttgcaaacccaaaggacccaagtactttccaatctcagtcactctaggactctgcactgaatggctgacctgacctgatgtccattcatcccaccctctcacagttcggacttttctcccctctctttctaagagacctgaactgggcagactgcaaaataaaatctcggtgttctatttatttattgtcttcctgtaagaccttcgggtcaaggcagaggcaggaaactaactggtgtgagtcaaatgccccctgagtgactgcccccagcccaggccagaagacctcccttcaggtgccgggcgcaggaactgtgtgtgtcctacacaatggtgctattctgtgtcaaacacctctgtattttttaaaacatcaattgatattaaaaatgaaaagattattgggaaag

SEQ ID NO: 57242 - DNA, 293 bp, Homo sapiens
  misc_feature 281, 290: n = A,T,C or G
catcttgattggattaattccaaattctaaaatgattcagtccacaatagctctaggggatgaagaatttgccttactttgcccagttcctaagactgtgagttgtcaaatccctagactgtaagctcttcaaggagcaagaggcgcattttctccgtgtcatgtaatttttctaaggtgtttggcagcactctgtaccctgtggagtactcagtaccttttgtttgatgttgctgacaagacctgaaaaaaaatcccttaaaaaaaaaacccattaaagngtagcaaanccg

SEQ ID NO: 57243 - DNA, 101 bp, Homo sapiens
acagaagaaaccccagcgagggatgccaaaggtagaaaaggtggaaaaaaatgggaccatcatctccatcattctgggtgacagagcaaggctcccatcgc

SEQ ID NO: 57244 - DNA, 237 bp, Homo sapiens
  misc_feature 27: n = A,T,C or G
gtgcagccaaaataaacaattcacagngtaaacagacaacctacaaaatgggagaaaatatttgcaaactatgcatctgacagaagactaatatcaagaaccaataaggacttaaataattaagcaaaagacaaaacccaattaaaacgtgggcaaaggttgaatagacatttctcaaaaaaagacacacaaacagctaacaagcatatgaaaaaatgttcatcatcattaatcatc

SEQ ID NO: 57245 - DNA, 487 bp, Homo sapiens
  misc_feature 10: n = A,T,C or G
taataacagnaaataaaggaatttagaaaaccaagccacaatagggagattcagcatagaataaagtttgttttttagaaaagataaaaaacttacacaaacctctaacaacattaatcaagaaaaaccaaaaatagtctacattttcatattaaattattgaatagtaaattatgtattaataatatttaatataaaaatatagatgtaatggaatatttcctagagaattaaaccttattaaaatcgatccaggaagatattttaaaactgaatacacttacatccattagggaaatgcaatcagttgggaaaataaaaaggagtcctagttattgacatgcttttatcaaactatcaggcaatacgtaactattaacttttaaatttttctagagaacagataatgtgttcctggtcagacacttactaactgtattcctaggtaaatgcttaacactctcactggcttaattaggataatgac

SEQ ID NO: 57246 - DNA, 464 bp, Homo sapiens
gattcctgagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgcctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaat

SEQ ID NO: 57247 - DNA, 294 bp, Homo sapiens
  misc_feature 5: n = A,T,C or G
aagangaacagctctttggacactaggaaaaaaccttgtagagagagtaaaaaatttaacaccatagtaggcctaaaagcagccaccaattaagaaagcgttcaagctcaacacccactacctaaaaaatcccaaacatataactgaactcctcacacccaattggaccaatctatcaccctatagaagaactaatgttagtataagtaacatgaaaacattctcctccgcataagcctgcgtcagattaaaacactgaactgacaattaacagcccaatatctacaatcaact

SEQ ID NO: 57248 - DNA, 229 bp, Homo sapiens
gtggagagggaatgtgaaatttacatcatttctttttgggagagacttgttttggatgccccctaatccccttctcccctgcactgtaaaatgtgggattatgggtcacaggaaaaagtgggttttttagttgaattttttttaacattcctcatgaatgtaaatttgtactatttaactgactattcttgatgtaaaatcttgtcatgtgtataaaaataaaaaagat

SEQ ID NO: 57249 - DNA, 309 bp, Homo sapiens
aaggcaaagcattggtagcaactcctggtaagtaagggtgctgccatcccagccaagggggcaaagaatggcaagaatgccaagaaggaagacagtgatgaagaggaagatgatgacagtgaggaggatgaggaggatgacgaggacgaggatgaggatgaagatgaaattgaaccagcagcgatgaaagcagcagctgctgcccctgcctcagaggatgaggacgatgaggatgacgaagatgatgaggatgacgatgacgatgaggaagatgactctgaagaagaagctatggagactacaccagcc

SEQ ID NO: 57250 - DNA, 466 bp, Homo sapiens
  misc_feature 16: n = A,T,C or G
aattatgagaaaaaangtatcagtttttatctatgtctctgaggaagtattattgacataattcttacttttaagtattaattaatatttattccttactcttcttgagaattgtacagtgatattttatatttcattgtcttaaatgttgctagctatcatttattttacttgctttaaagaactctttggtgtaatactacttccctacatatgagatactctgcataatcattgtaatgatacatctctatttatactgatattggcatattattattttatttatgggatgagactcaaacttatatggcttatccttttagcaaatgtatttcataatgatgttctgtaagatttaaaaagtaggcaaagctgccagggtgtggtggctcgcacctgtaatcccaacactttgggagaccaaggcgggtggatcacctcaggtcgggagttctagaccaga

SEQ ID NO: 57251 - DNA, 485 bp, Homo sapiens
aggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaatgccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttg

SEQ ID NO: 57252 - DNA, 378 bp, Homo sapiens
gatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattccac

SEQ ID NO: 57253 - DNA, 204 bp, Homo sapiens
  misc_feature 9: n = A,T,C or G
ataaacagnaagtaagatgtcctctttcccaggtttgcacaatcacttctggcaaattaattgaaggtccttgaattcagccagtgcacgaaacctttgcatgttcttctgaaactgtacttcttccctattctgtctacccacactctgcgaactttgccttttccttaaacacattccagaccaaacactgttcagtttggt

SEQ ID NO: 57254 - DNA, 471 bp, Homo sapiens
accgtgtgtttccaaaatggcggcagcgatggatgtggataccccgagcggcaccaacagcggcgcgggcaagaagcgctttgaagtgaaaaagtggaatgcagtagccctctgggcctgggatattgtggttgataactgtgccatctgcaggaaccacattatggatctttgcatagaatgtcaagctaaccaggcgtccgctacttcagaagagtgtactgtcgcatggggagtctgtaaccatgcttttcacttccactgcatctctcgctggctcaaaacacgacaggtgtgtccattggacaacagagagtgggaattccaaaagtatgggcactaggaaaagacttcttccatcaagcttaattgttttgttattcatttaatgactttccctgctgttacctaattacaaattggatggaactgtgtttttttctgctttgttttttcagtttgctgtttctg

SEQ ID NO: 57255 - DNA, 474 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcacggagtaaaaaatgtatttaaaagaaaattgagagaaaggactacagagccccgaattaataccaatagaagggcaatgctttagattaaaatgaaggtgacttaaacagcttaaagtttagtttaaaagttgtaggtgattaaaataatttgaaggcgatcttttaaaaagagattaaaccgaaggtgatt

SEQ ID NO: 57256 - DNA, 427 bp, Homo sapiens
gtctgtaggacacaaatgccagaccctaagtaccttcaagcagcactttgagagcaagcatcctaagactccacttcctccagaattagctgatgttcaggcataaggttgtttacaggtgaattcatgacacctttgactcttctactgtctcagaccttaggtaacatacctgcagctgcttttctaacaaactgttgatcagcaaaaataaaggggctacagaaacactcatttttatgctgttccctcttgggcttcatgcaaagacaattctgtgtaaatgtacagttgactctgatttggaaatatgaaaatcagtccatccttgttataaaaaatttttttacaattgtaattatattgatgttcatattgtgtaaaataactcatttaataaaatagtactttgatttacgacatcact

SEQ ID NO: 57257 - DNA, 391 bp, Homo sapiens
gaagacgcttcagttaagtgaggttactggtgtgttggatgtttaattcagcaccagcattgcatgacagttgtttgaataacaagtggtttatttttaaaaccataccttttaaaatttaggttcagataatagtaaaagtcatcataataatttaaaggaaaaccagcagaaatcgaagcaaacatgtctggagaagtgcgtttgaggcagttggagcagtttattttggacgggcccgctcagaccaatgggcagtgcttcagtgtggagacattactggatatactcatctgcctttatgatgaatgcaataattctccattgagaagagagaagaacattctcgaatacctagaatgggctaaaccatttacttctaaagtgaaac

SEQ ID NO: 57258 - DNA, 376 bp, Homo sapiens
  misc_feature 225: n = A,T,C or G
acgacaaggtgaatgcacaatatttgcagctgttcgtgatttaatggctaatcttacactgccccctggtgggcgtccatagacactattgtttttaaaccaggaaggctgacagatgagacaacaaaaaaaatctgaattcagccttcagtttaaaaaaggaaaaggactttttttttaaactttaagagctaaatattctaaactggcaaaaattttcagggngcacttctttcatcaaaatgatcatccatcttttgtataatgaactcgtatagtgtgtttaaatgggacacatttcaaaggaaataaatcagtgtccgtttgccagtaataaatttaatattctgttttatactataaagtcatgaaaatg

SEQ ID NO: 57259 - DNA, 490 bp, Homo sapiens
  misc_feature 27: n = A,T,C or G
gcatcagaatacacttcgtatcaaagnagattcatgatggtctggatttttattattcctcaaaacaacatgctcagaagatggtcgaatttcttcagtgtacagttccctgtagatacaaagcatcacaaagactgatctctcaagatatccatagtaacacatacaattacaaaagcactttttctgtggaaattgttccaatatgcaaggataatgttgtctgtctgtctccaaaactggcacaaagcctgggaaatatgaaccagatttgtgtgtgtattcgagtaaccagtgccattcacctcattgatccaaacaccctacaagtggcagatattgatgggagcactttctggagtcaccctttcaatagtttatgtcatcccaaacagctagaggagtttattgtgatggaatgcagcatagtccaagatataaaacgtgctgcaggtgctggaatgatatcaaaaaagcataccctcgggga

SEQ ID NO: 57260 - DNA, 224 bp, Homo sapiens
aactgaaactgaatccttccatttcttctgcacatctacttgcttaaattgtgggcaaaagagaaaaagaaggattgatcagagcattgtgcaatacagtttcattaactccttccctcgctcccccaaaaatttgaatttttttttcaacactcttacacctgttatggaaaatgtcaacctttgtaagaaaaccaaaataaaaattgaaaaataaaaaccat

SEQ ID NO: 57261 - DNA, 474 bp, Homo sapiens
gaatgaagaatggcaccccagttggttgtataagtctcataagataatgatgttgatcttaaatatggatgtctcaatgcctgttttctatcaatgatttgtttgtttccaaggtcggggagggaaagaggggagggtttatctgttttagaaagtctcagaatacttataaaatacagaagtagttattaaaatatataggacctcacataggtagatacagaacttaccattgaggctgatgggctgttgtgtgaatcacacaggaccttaaatgaggctcattattctcacacaccaaaatgactctgacagcctgaagcagttattgctagagcccaagctttccttagaggttttggagttaggttgattggaagtaaccagctaataccttttctagtggagaaaaacacattgctaccagcttgttcatcccatagaagtcttccactctgctccatttttagcagc

SEQ ID NO: 57262 - DNA, 106 bp, Homo sapiens
gaatcagggttcgattccggaaagggagcctgagaaacggctaccacatccaaggaaggcagcaggcgcgcaaattacccactcccgacccggggaggtagtgacg

SEQ ID NO: 57263 - DNA, 135 bp, Homo sapiens
  misc_feature 41: n = A,T,C or G
gtaattttaatagcttaagattttaagagaaaatatgaagnacttagaagagtagcatgaggaaggaaaagataaaaggtttctaaaacatgacggaggttgagatgaagcttcttcatggagtaaaaatgtctt

SEQ ID NO: 57264 - DNA, 364 bp, Homo sapiens
  misc_feature 8: n = A,T,C or G
gctcggancctaggtcgcggcgacatggccaaacgtaccaagaaagtcgggatcgtcggtaaatacgggacccgctatggggcctccctccggaaaatggtgaagaaaattgaaatcagccagcacgccaagtacacttgctctttctgtggcaaaaccaagatgaagagacgagctgtggggatctggcactgtggttcctgcatgaagacagtggctggcggtgcctggacgtacaataccacttccgctgtcacggtaaagtccgccatcagaagactgaaggagttgaaagaccagtagacgctcctctactctttgagacatcacctggcctataataaatgggttaatttatgtaacg

SEQ ID NO: 57265 - DNA, 365 bp, Homo sapiens
  misc_feature 8, 10: n = A,T,C or G
aattcggntnttatggcgcggggaaactagtctcaggcttcaacatcgaatacgccgcaggcccccttcgccctattcttcatagccgaatatacaaacattattataataaacaccctcaccaccacaatcttcctaggaacaacatatgacgcactctcccctgaactctacacaacatattttgtcaccaagaccctacttctaacctccctgttcttatgaattcgaacagcatacccccgattccgctacgaccaactcatacacctcctatgaaaaaaacttcctaccactcaccctagcattacttatatgatatgtctccatacccattacaatctccagcattccccctcaaacct

SEQ ID NO: 57266 - DNA, 470 bp, Homo sapiens
cgacggtggtggtgactgagcggagcccggtgacaggatggctgggcacagattggtgttggtattaggagatctgcacatcccacaccggtgcaacagtttgccagctaaattcaaaaaactcctggtgccaggaaaaattcagcacattctctgcacaggaaacctttacaccaaagagagttatgactatctcaagactctggctggtgatgttcatattgtgagaggagacttcgatgagaatctgaattatccagaacagaaagttgtgactgttggacagttcaaaattggtctgatccatggacatcaagttattccatggggagatatggccagcttagccctgttgcagaggcaatttgatgtggacattcttatctcgggacacacacacaaatttgaagcatttgagcatgaaaataaattctacattaatccaggttctgccactggggcatataatg

SEQ ID NO: 57267 - DNA, 269 bp, Homo sapiens
gaaaatggcactgaggaagctgctaaaaaacctaaaaagaagaaaaagaagaaagacccagagacatatgaagtggacagtggtaccacaaagctagcagatgatgcagatgacactccaatggaagagtcagccctgcagaatactaataatgcgaatggcatctgggaggaggagccaaagaaaaagaagaagaagaaaaagcaccaggaagttcaggaccaggaccctgttttccaaggcagtgactccagtggttaccaaagtga

SEQ ID NO: 57268 - DNA, 472 bp, Homo sapiens
gaattaggatgcggagcccttgggaggtcgtaagcatggagcccacgtgagtgggattagtgcccttatgaagagatcccagccctctttctgccatgcgaacacacagcaagaagatgcctgtctatgaaccagggggcccttaccagaaacaaacctactagcatcttgatctcggactttccagttcccataaccatgagaaataaatgtttttaattcaatgtatggtattttattatagcagctctacctaagacagtacatgtatagtgtctatttgaacattactgataatgttgaacaacttttcatgtttattagttattaggtttcttcaagtgttcttattcatacaaattttaaaatatgtacacaagttctttgttatatattttgcaaatatcttctgtggcttgtcttttcactattttagttctgtcttttgataaacaggagcttttaattttta

SEQ ID NO: 57269 - DNA, 159 bp, Homo sapiens
  misc_feature 12, 25: n = A,T,C or G
gaaaacgaaagnaagaaacaaaagnaaagcatcatgatgaataaaatgtctttgcttgtaatttttaaattcatatcaatcatggatgagtctcgatgtgtaggcctttccattccatttattcacactgagtgtcctacaataaacttccgtattttc

SEQ ID NO: 57270 - DNA, 473 bp, Homo sapiens
ataacttgtgtgatttcaaattaaacttgcattatgtgttaattttcttgcatctaaaaaagcatagaattcctactcacacagctcagcaacaaccattttgatggtaacagttaatttctttcattagtttttttaaattcagggttctggatattaaattaaaatggcattcttaaagattttcttcaaaaagcaatcctaaatgaaagtgtgtaaattataagaagctggcgatcttttgatatgctgtttcacaggatcctgacactggagggcagctgtcttgtgcattacttgtgtttccagcaccaaagttgtgggacatgttgctgtagactgctgcgcagtcctgggtgcattcagtctctctgcctctgcctgcctcctggtccccactttaaaggctgtgcagctccttaaataataaagctggaaaatatttttagtccgggttatcaaatttgatttac

SEQ ID NO: 57271 - DNA, 500 bp, Homo sapiens
  misc_feature 3, 11, 29: n = A,T,C or G
aancacaaagnctgggctcttttgaaggnttggtaaacctgaccttcatccatctccagcacaatcggctgaaagaggatgctgtttcagctgcttttaaaggtcttaaatcactcgaataccttgacttgagcttcaatcagatagccagactgccttctggtctccctgtctctcttctaactctctacttagacaacaataagatcagcaacatccctgatgagtatttcaagcgttttaatgcattgcagtatctgcgtttatctcacaacgaactggctgatagtggaatacctggaaattctttcaatgtgtcatccctggttgagctggatctgtcctataacaagcttaaaaacataccaactgtcaatgaaaaccttgaaaactattacctggaggtcaatcaacttgagaagtttgacataaagagcttctgcaagatcctggggccattatcctactccaagatcaagcatttgcgtttggatggcaat

SEQ ID NO: 57272 - DNA, 472 bp, Homo sapiens
atggtggttttcagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatctt

SEQ ID NO: 57273 - DNA, 474 bp, Homo sapiens
  misc_feature 10, 421: n = A,T,C or G
aatccaaggnactgtctcatcgaaatctgctgggagatgacaccacagactgttccttcattttcctgtatattctctgtactatgtcgattcgacagaacattcagaagattctcggccttgccccttcacgagccgccaccaagcaggcaggtggatttcttggcccaccacctccttctgggaagttctcttgaactcaagaactctttattttctatcattctttctagacacacacacatcagactggcaactgttttgtagcaagagccataggtagccttactacttgggcctctttctagttttgaattatttctaagccttttgggtatgattagagtgaaaatggcagccagcaaacttgatagtgcttttggtcctagatgatttttatcaaataagtggattgattagnttaagttcaggtaatgtttatgtaatgaaaaacaaatagcatccttcttgttt

SEQ ID NO: 57274 - DNA, 369 bp, Homo sapiens
  misc_feature 21, 29, 39, 368: n = A,T,C or G
gcatgggtggctacgtaaagnaggccaanttaccggaanaaaccattgtggaattgcctcagcagccagctaccccactgtgtgagctggtggacggtgatgaggaaggacttgactggggatggcgcatgcatgggaggaattcatcttcagtctaccagcccccgctgtgtcggatacacactcgaatcattgaagatccgagtgtgatttgaattctgtgatattttcacactggtaaatgttacctctattttaattactgctataaataggtttatattattgattcacttactgactttgcattttcgtttttaaaggatgtataaatttttacctgtttaaataaaatttaatttcaaatnc

SEQ ID NO: 57275 - DNA, 476 bp, Homo sapiens
  misc_feature 7: n = A,T,C or G
atcaganaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctactttcactta

SEQ ID NO: 57276 - DNA, 349 bp, Homo sapiens
agttaatgaaattgagagaactggctgtacttttggaagagattaaaattttatttccagcctggcacagtggctcactcctgtaatcccagcactttgggaggccaagacaggtggatcacctgagctcatgagttcgagaccagcctggccaacatggtgaaaccaacactgtctctactaaaaatacaaaaattatctggctgtggtggttggtgcctataatcccaggtgttggggaggctgaggcaggagaattgcttgaacccagaaggcgaagtttgtagtgagccgagatcacggcattgcactccagcttgggcgacaagagtgaaactttgtctaaatt

SEQ ID NO: 57277 - DNA, 465 bp, Homo sapiens
cagaaggaagcatggacaggtcccttgtttcaaaggtatggcacaaggtaacctgtaagccagggtgcccagaccagttcccgtacatagacacttggttacagctggttttagaccccctccctacccccacggtggttgagagaacagcagcataagcagctggcagaggcaaggaaagaccagcaaagaggcagagaagaaagagacaggaaaagaggcaaagagagagaagaagagagagaggaagagacagagagacaaagagggagtcaaggagaaagagagagagaggaagagacagaggcaaaaggaaagtcaaaaagagagacaatgtcaaagacagagaaatatacaagtagttaaaaaaaagtgtgccctattcctttaaaagccagggtaaatttaaaacctataattgataattgaaggtattctctgtaaccctataacactccaatacca

SEQ ID NO: 57278 - DNA, 115 bp, Homo sapiens
tgatgacagcgcctcatcttcaacttttgtgctcccctttgcctaaaccgtatggcctcccgtgcatctgtactcaccctgtacgacaaacacattacattattaaatgtttctc

SEQ ID NO: 57279 - DNA, 473 bp, Homo sapiens
atctgagggaaatgttttgtaaacatttattttttttaaagaaaagatgaaaggcaggcctatttcatcacaagaacacacacatatacacgaatagacatcaaactcaatgctttatttgtaaatttagtgtttttttatttctactgtcaaatgatgtgcaaaaccttttactggttgcatggaaatcagccaagttttataatccttaaatcttaatgttcctcaaagcttggattaaatacatatggatgttactctcttgcaccaaattatcttgatacattcaaatttgtctggttaaaaaataggtggtagatattgaggccaagaatattgcaaaatacatgaagcttcatgcacttaaagaagtatttttagaataagaatttgcatacttacctagtgaaacttttctagaattatttttcactctaagtcatgtatgtttctctttgattatttgcatgtta

SEQ ID NO: 57280 - DNA, 477 bp, Homo sapiens
gtccctggaggagctctgcctggaagtcaacgtcaccacctcacagggcgccacccttgacgcttgcagcttcggagtcacgggtttgaaacttcaaggggccacgtgcaacaacaacaagctgtcactgtccaatgccatctcaaccgcccttcccctgacgcagctgcgctgggtcaagcagacaaacaccgagaagaaggccagtgtggtaaccttacctgtctacctgaacttcacccgtgcagacctcatcttcaccgtggacttcgaaattgctacaaaggaggatcctcgcagcttctacgagcggggtgtcgcagtcttgtgcacagagtaaacttttctagctgcccctttctgtaatagtgaaagttggtatttaacattttattcatttttaaaatatttgggaaggtctgagcttgtgaaaagaaagtggttggtctgaggttggaggaagctgaatggaatctg

SEQ ID NO: 57281 - DNA, 462 bp, Homo sapiens
ctttggcaagatggcggggagcggcgtccgccaagttacttctaccgccagcaccttcgtgaagcccattttcagtcgggacatgaacgaggccaagcggagggtgcgcgagctctaccgcgcctggtatcgggaggtgccgaacactgtgcaccaattccagctggacatcactgtgaaaatgggacgggataaagtccgagaaatgtttatgaagaatgcccatgtcacagaccccagggtggttgatcttctggtcattaagggaaagatcgaactggaagaaacaattaaagtatggaagcagcggacacatgttatgcggttcttccatgaaacagaagcgccaaggccaaaggatttcctatccaagttctatgttggccacgatccatgaagtcattcagtggaaagatgcacgttgatactattttagagcacaaataaactcactatacaatg

SEQ ID NO: 57282 - DNA, 258 bp, Homo sapiens
gcttacatgaaataccagtgaaaaaaggtgaaggtgccgagctataaacctccagaatattattagtctgcatggttaaaagtagtcatggataactacattacctgttcttgcctaataagtttcttttaatccaatccactaacactttagttatattcactggttttacacagagaaatacaaaataaagatcacacatcaagactatctacaaaaatttattatatatttacagaagaaaagcatgcatatcat

SEQ ID NO: 57283 - DNA, 300 bp, Homo sapiens
atattacaaaagctaaacatttgtgaacagtacttaaataaattgtgatactattgctccatcattgaactttttgaaactttaacaattgtataaaactgtcagtttgttgtttcatttgtaattacaaaataatttaaaaactttttaaaataatttggatcctgactttgtctatatctgtatttcatttgtttagaaagattcttttgggtttgataatgtaatttgtatatttaaattttttatggacataattcaaaggaatgtataaattggtcttttgttaaatggcttttt

SEQ ID NO: 57284 - DNA, 474 bp, Homo sapiens
gacagcgctggtgcggagactgcttccggactccaggtaccgcgcttggcggcagctggccccagacttctgtcttttcagctgcagtgaaggctcggggctgcagaattgcaaccttgccaatggacctgatcggttttggttatgcagccctcgtgacatttggaagcatttttggatataagcggagaggtggtgttccgtctttgattgctggtctttttgttggatgtttggccggctatggagcttaccgtgtctccaatgacaaacgagatgtaaaagtgtcactgtttacagctttcttcctggctaccataatgggtgtgagatttaagaggtccaagaaaataatgcctgctggtttggttgcaggtttaagcctcatgatgatcctgagacttgtcttgttgctgctctgagcatctggaggaacagaaaactaagttcatgtcatcctgctgtaatgggcag

SEQ ID NO: 57285 - DNA, 475 bp, Homo sapiens
gagtttcctgaggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttac

SEQ ID NO: 57286 - DNA, 473 bp, Homo sapiens
  misc_feature 5: n = A,T,C or G
caganaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgtttctaagatttggtttgggatcaataggaaagcatatgcagccaaccaagatgcaaatgttttgaaatgatatgaccaaaattttaagtaggaaagtcacccaaacacttctgctttcactt

SEQ ID NO: 57287 - DNA, 293 bp, Homo sapiens
attaaagatagttctgagccgggcgtggtggctcacgcctgtaatcccagcactttgggaggctgaggtgagcagatcacgaggtcaggagttcaagaccagcctggccaatatggtgaaaccccatctctactataaatacaaaaattagtagggcgtggtggcacatgcctgtagtcccagctactcaggaggctgaggcaggagaatcacttgaacctgggaggcagaggttgcagtgagctgagatcatgccactgtactctagccagggcaacagagtgagacgctgt

SEQ ID NO: 57288 - DNA, 477 bp, Homo sapiens
  misc_feature 414: n = A,T,C or G
aaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggngggtgattattttttatactgtatgtgccaaagctttactactgtggaaagacaactgtttta

SEQ ID NO: 57289 - DNA, 425 bp, Homo sapiens
gaacttggaactgtcatgaggtcactgggtcagaacccaacagaagctgaattgcaggatatgatcaatgaagtggatgctgatggtaatggcaccattgacttccccgaatttttgactatgatggctagaaaaatgaaagatacagatagtgaagaagaaatccgtgaggcattccgagtctttgacaaggatggcaatggttatatcagtgcagtagaactacgtcacgtcatgacaaacttaggagaaaaactaacagatgaagaagtagatgaaatgatcagagaagcagatattgatggagacggacaagtcaactatgaagaattcgtacagatgatgactgcaaaatgaagacctactttcaactcctttttcccccctctagaagaatcaaattgaatcttttacttacctcttgc

SEQ ID NO: 57290 - DNA, 338 bp, Homo sapiens
gtccctgagcaagtttcctctgtaattttatgcgtaactttaagaggaaccacaaaatggtcatccactttaaaaactgtgggtaccttttcatcagtggggcatgttccaaacccaaaggaagcaaaggtgataaatgatgtgtacttattagttgagtgctgggcactgtgctgacaccaggggatgccaaaatgaaaggaacaggtatgtttcctgtccttttgaagcttgactgctagtgagagaatccaataaccaagaaaaagtaaggatgtaaataaaataagtatatgcctagcactgggaagaaagtataataaacaaacaggatactg

SEQ ID NO: 57291 - DNA, 224 bp, Homo sapiens
gtacggtgatattggcggacttaaggacatcgaattgtttatcaggaataaagtattatgtgtgttttctgcggccctggataatgctgtagcattcagggtcgattgagtaaaaaaaatgtagagatggtttcctgtttgtttttgcttctagttttcattcatttgctatttattctcttctggctttgcttgtgtatgcatatatataaaaccattattat

SEQ ID NO: 57292 - DNA, 440 bp, Homo sapiens
  misc_feature 24: n = A,T,C or G
attttaaatgaagtgattctaagnatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacatt

SEQ ID NO: 57293 - DNA, 467 bp, Homo sapiens
gtttttagcggcactctgggtagcagggtggtgtgatagcggcagcgaggggctcggagaggtgctcggattctcgtagctgtgccgggacttaaccaccaccatgtcgagcaaaagaacaaagaccaagaccaagaagcgccctcagcgtgcaacatccaatgtgtttgctatgtttgaccagtcacagattcaggagttcaaagaggccttcaacatgattgatcagaacagagatggtttcatcgacaaggaagatttgcatgatatgcttgcttcattggggaagaatccaactgatgagtatctagatgccatgatgaatgaggctccaggccccatcaatttcaccatgttcctcaccatgtttggtgagaagttaaatggcacagatcctgaagatgtcatcagaaatgcctttgcttgctttgatgaagaagcaactggcaccatacaggaagattact

SEQ ID NO: 57294 - DNA, 473 bp, Homo sapiens
tgtctaaatgcatttaaatctgttttattcaaagaaaagctaaagcaaaaacactggcatatgaccatgcaagactgtcagtgccaacaaagacaacactaatcagcacatcgtacactggattgcagtgcttcccagattattgaaaaatgttacagacaacttgcctgatttttaaatgagcgtaaaaggccctctaacctatgcaggtttccccattatgcatatagaaaatgctagtatgttttgctcacttcatatgtaacaggtgcccttatgttgtgctgtatcctgtgctttttctgtgggaccattccattcaggagcaaagagcaccatgattccaatcttgtgtgtgtttactaacccttccctgaggtttgtgtatgttggatattgtggtgttttagatcactgagtgtacagaagagagaaattcaaacaaaatattgctgttcttcagttttgtttgt

SEQ ID NO: 57295 - DNA, 425 bp, Homo sapiens
  misc_feature 23: n = A,T,C or G
gagtgaaaagggcagaagcaagnaaatttctacatcttagcgactccaagaagaatgagtatccacatttagatggcacattatgaggactttaatctttccttaaacacaataatgttttcttttttcttttattcacatgatttctaggtatatttttcatgcaggacagtttttcaaccttgatgtacagtgactgcgtaaaatttttctttcagtggcaacctctataatctttaaaatatggtgagcatctcgtctgttttgaaggggatatgacaataaatctatcagatgggaaatcctgttacaaagtagaaaagctttagtaatttactcagtgtggtggttttatcctttttttctttttctcccttggtctataatgaaattgttacagcagtgcaaaataaaatcctatgtat

SEQ ID NO: 57296 - DNA, 489 bp, Homo sapiens
  misc_feature 19: n = A,T,C or G
gtaacaaaacaactgaagnaatgtttaataaatattgtacttattggaagtaatatcaaactgtatggtgataagtattgttttgattcttatggttaaagggaaatagagccttgcattatattcaacacagccatttgtgtgtgcacaatgcaaactaaggtattctagacctatcttagagcagcatccagtatttgctttctagataatatgcccaataacatgacctagaggggcttctgtgctgtgtagggatttaaccaacttcagtggttcagggagctcaaactatatgtaaaacaagtttagaatgtatgctatctagcccgttatctctgatccttctctaaaaccatttgaaatagcttcattgatcaacatttcataaatgcatctgtggtagaggtagaaagcagcacctttcctaattggcaaatgatcagactaatgtgtgctaatgtttttcttccatgctttcagtcagat

SEQ ID NO: 57297 - DNA, 290 bp, Homo sapiens
  misc_feature 2: n = A,T,C or G
tncctgaaggtgaaggggaatgtgttcaaaaacaagcggattctcatggaacacatccacaagctgaaggcagacaaggcccgcaagaagctcctggctgaccaggctgaggcccgcaggtctaagaccaaggaagcacgcaagcgccgtgaagagcgcctccaggccaagaaggaggagatcatcaagactttatccaaggaggaagagaccaagaaataaaacctcccactttgtctgtacatactggcctctgtgattacatagatcagccattaaaataaaacaag

SEQ ID NO: 57298 - DNA, 488 bp, Homo sapiens
  misc_feature 28, 182, 183: n = A,T,C or G
attcctgaagctgacagcattcgggccnagtatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttnntccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattgatatgcttatacacttaca

SEQ ID NO: 57299 - DNA, 297 bp, Homo sapiens
  misc_feature 18: n = A,T,C or G
atggtgaaactcctaagnaaacaggtggttttgctggaaacttggtagacccttaattatagtggtgctaatgagcactactgtaatataaagccaccattattttttatcaaacatctgaatacattttacaaaggctattgtgagggcattattttgagcatctattttgaggtgatgttttaaaaaactttaacatcaaatcaaattgtaaattaatttaaatatattgccttaaggacctactaaagaatgtgccaccagactttaagtgatagttgcaatatccttgtctag

SEQ ID NO: 57300 - DNA, 472 bp, Homo sapiens
gtgttatataatgcatatattttggaacttgccatttcactcagcattgtgtttttgaaattcattcatattgatatatgtgggtttttaataatttttgatatagaatattgcatcatacatatgctataaattgtttctctatttcgatagtgatttctaatattctattattttttaaaatgcagcaaacatcctgtgcccttctgtgttgcagaatatatatgcagtttcagcttactcgataatgcaaaatttaccttcccagttagagtactgatgaatcagtaactgaaaaggccctgaacacttattgtaataatctaggtatgatcagcatctgttgctttacactttaaagccccagtcaacttgggggataggaaaggttcaatttagcatcctgttgacagtgctaaataactcactattaaacagaaatcaaaagagaaactttcaattcttagaactg

SEQ ID NO: 57301 - DNA, 459 bp, Homo sapiens
attgagtttcaacagcatctctgctgttgacaatggctctctggccaacacgcctcatctgagggagcttcacttggacaacaacaagcttaccagagtacctggtgggctggcagagcataagtacatccaggttgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacctggcaaaatcttgttaatgtcattgctaaaaaataaataaaagctagatactggaaacctaactgcaatgtggatgttttacccacatgacttattatgcat

SEQ ID NO: 57302 - DNA, 490 bp, Homo sapiens
  misc_feature 20, 21, 31, 256: n = A,T,C or G
gatgtgtggcaaatcaaatnnactgttgaanaaggggtgagttttctgtgctacaagcacctgtcactgttggtacttgcaggaggcttctgctgggtatgttttggaagtgagtgtcactacttagctttgcttagcaggttctgcttcacacttgttctttgacctgctgacttgtgacttgcagaaacataggcagtagtcctagcctggtaaagaccctccaccacccctataagtttgattgctatgcaantttgggagaggaggcctattgggctcttggatggaaccctttcccgtattaaacaaaccagagacagaatcagtgctgactcaggatctcctggtttggaatcgtaatgtgcctcaatcctctttccaagcaggcctcaccagtctctttctctttcctgcttcacccctgcaatgagccaagaaccaacactacatccacctagaactgcagaagggcttgtggtttcaacca

SEQ ID NO: 57303 - DNA, 495 bp, Homo sapiens
  misc_feature 3, 5, 29, 31, 214: n = A,T,C or G
aangncggttataatttatactcttctantntaatggtgcacatataagttaagcatagcagtaaaaatttgcttcaaacaaataaacaaaatacctatttttaaagtgaaaaatgtgcaaagaatatacattttaggcccataaaaaggatatgggacattctctttcctatcccaatatacctattcatttccttcagctcactgaaacttnattttatgaacttacttaatgtaaataaacaaatgaaaaaataaacaaataaacttcttggtgccatggtaaatgtttcaactatgttgcaattaaatatcttgtatcaaaaattttaagaaaactaaaagttgaaactaaaaggtgtgaacaatcaatcacaggacaatgattttatgcctttattttaaaaatggaaggtgaaattgagctttgcttttctacaacatccattaactgctcttttaaaaaagaaataccaaaaagcataacgtcgtagt

SEQ ID NO: 57304 - DNA, 190 bp, Homo sapiens
aaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaacactctttatgataac

SEQ ID NO: 57305 - DNA, 471 bp, Homo sapiens
  misc_feature 40: n = A,T,C or G
aactgaagaagctgcatataaaccacaacaacctgacagnagtctgtgggcccacttcccaaatctctggaggatctgcagcttactcataacaagatcacaaagctgggctcttttgaaggattggtaaacctgaccttcatccatctccagcacaatcggctgaaagaggatgctgtttcagctgcttttaaaggtcttaaatcactcgaataccttgacttgagcttcaatcagatagccagactgccttctggtctccctgtctctcttctaactctctacttagacaacaataagatcagcaacatccctgatgagtatttcaagcgttttaatgcattgcagtatctgcgtttatctcacaacgaactggctgatagtggaatacctggaaattctttcaatgtgtcatccctggttgagctggatctgtcctataacaagcttaaaaacataccaactgtcaat

SEQ ID NO: 57306 - DNA, 294 bp, Homo sapiens
  misc_feature 19: n = A,T,C or G
gagtaggtggaacaacagnatgtgtgctactgcccctggcctgctgcacaattattataaaaatgaattaaatcctacctagtgggagaaaattgactgtgatcttataattttttgttccagaaacttttatactgtagaatatattgtcagtcattaagattttctatttttaattgagttaaaataggattgttgctttttaaaattactttctgacatcattgtttcatgcatttttaatgcctttagtccagtggatatagaagtacaggaatctccaaggcaaatgtc

SEQ ID NO: 57307 - DNA, 463 bp, Homo sapiens
gcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgc

SEQ ID NO: 57308 - DNA, 336 bp, Homo sapiens
  misc_feature 333: n = A,T,C or G
aacgtgcagcggctgaaggaagtaccgctccaaactcatcctcttccccaggaagccctcgacccccaagaagggagacagttctgctgaagaactgaaactggccacccagctgaccggaccggtcatgcccgtccggaacgtctataagaaggagaaagctcgagtcattactgaggaagagaagaatttcaaagccttcgctagtctccgtatggcccgtgccaacgcccggctcttcggcatacgggcaaaaagagccaaggaagccgcagaacaggatgttgaaaagaaaaaaataaagccctcctggggacttggaatcagtcggcngtc

SEQ ID NO: 57309 - DNA, 296 bp, Homo sapiens
  misc_feature 24: n = A,T,C or G
gcggtgcggaggtcagggacaagnatggtgccaccggtgcaggtctctccgctcatcaagctcggccgctactccgccctgttccccggtgtggcctacggagccacgcgctacaattacctaaaacctcgggcagaagaggagaggaggatagcagcagaagagaagaagaagcaggatgaactgaaacggattgccagagaattggcagaagatgacagcatattaaagtgagtgaccctgcgacccactctttggaccagcagcggatgaataaagcttcctgtgttgtgtga

SEQ ID NO: 57310 - DNA, 373 bp, Homo sapiens
  misc_feature 21: n = A,T,C or G
gcagagttgagtgtcctgagnagtcagattgctgtcagacatggcccatgaacatggacatgagcatggacatcataaaatggaacttccagattatagacaatggaagatagaagggacaccattagaaactatccagaagaagctggctgcaaaagggctaagggatccatggggccgcaatgaagcttggagatacatgggtggctttgcaaagagtgtttccttttctgatgtattctttaaaggattcaaatggggatttgctgcatttgtggtagctgtaggagctgaatattacctggagtccctgaataaagataagaagcatcactgaagataatacctggaagcatcatagtggtttcttaac

SEQ ID NO: 57311 - DNA, 364 bp, Homo sapiens
  misc_feature 25: n = A,T,C or G
gaaccgaatcaaaggagagaccagnactctggcctcatacccagcctatttgaaacaagctatctagtttctcctgcagacaccttgtcaacaacatgcaacagtgtcaggtgccttgcaggaaaataatctgagtcccaagctagcctgtgctcatccacaatcacaatgaacatgtcaaggaagaatttgcagagactcaagggaagcacaatgggataaggtaatcactttcagtgaaaaactgttttcttgaaaacaggcttggacacaattgaaagctggcttcctgcaaacacaccaagagtctgtaatctagcctatccattatatgtcctttattattcatgatatcctattcttc

SEQ ID NO: 57312 - DNA, 368 bp, Homo sapiens
  misc_feature 30, 31: n = A,T,C or G
gataataacagtaaacttcccaaacctagnngaagatatcaaaatcctaatacaagaaggttatagaacaccaagcagatttaacccaaagaaaactacctcaaggcttttaataatcaaactaccaagggtcaagcataaaggaaagattccaacagcagcaagagaaaagaagcaaataacataaaatggagctccaataggtctcacagcagacttttcaatggaaaccttacaggccaggagagagcggcatgacatgtaaagtgctgaaggaaaagaaaacatttactctagaataatacatatcgtgaaaatatccttcaaatgtgaagaagaaataaagacttccccagacagacaaaagc

SEQ ID NO: 57313 - DNA, 177 bp, Homo sapiens
  misc_feature 11, 22, 27, 30: n = A,T,C or G
gactttcttgncccccgggaancccgnctntttatgggccccggggcagtttataaaggggagagagcaagcagcgagtcttgaagctctgtttggtgctttggatccatttccatcggtccttacagccgctcgttagaactccagcagcccagatggtgaagcagatcgagagcc

SEQ ID NO: 57314 - DNA, 377 bp, Homo sapiens
gcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattgaccatttaagtttagtagta

SEQ ID NO: 57315 - DNA, 239 bp, Homo sapiens
  misc_feature 2, 6: n = A,T,C or G
tnaatntggagaagcttccgtgatgcacagtatctgctgttctccagtcctctgtctttctttgtcattcagttctaggcctttcctctgcacgctcaatgcccagtaaaatttcaggattaactgaagaagaggaaatatagaagaaaagtttcttcttaattttttaaaaaatacatttccttctgaaatctgagcccatttctgggaaagagaaagaaagagagagaaagagagag

SEQ ID NO: 57316 - DNA, 386 bp, Homo sapiens
  misc_feature 9: n = A,T,C or G
ataaaagangcagggtaccccaaaccaattttcaaaggatttggaggactaactggacaaatagtggcagcgctttcaacagctaaatataagaactggcctgaatctgtgtattttttcaagagaggtggcagcattcagcagtatatttataaacaggaacctgtacagaagtgccctggaagaaggcctgctctaaattatccagtgtatggagaaacgacacaggttaggagacgtcgctttgaacgtgctataggaccttctcaaacacacaccatcagaattcaatattcacctgccagactggcttatcaagacaaaggtgtccctcataatgaagttaaagtgagtatactgtggagaggacttccaaatgtggttac

SEQ ID NO: 57317 - DNA, 250 bp, Homo sapiens
  misc_feature 2, 3, 18: n = A,T,C or G
annttgttagccttttantgaaatttgtaatttgttgtaatttctttctaaataagtatttacttttgtctctaattttgtccatctatttttgaattcaattttcaaattcaaaacgcttctctcggccgggcacggtggctcacgcctgtaatcccagcactttgggaggtcgaggagggcggatcacgaggtcaggagatcgagaccatcctggctaacacagtgaaaccccgtctctactaaaaat

SEQ ID NO: 57318 - DNA, 370 bp, Homo sapiens
  misc_feature 13, 35, 137: n = A,T,C or G
tatggccgggtantgtcaagcaaattaagtaaacntctatgaagagactgaaaatggaatgtttttggaagtaaatagaaactgctaagcacctagcaataaagaattacaacaactcaaggaaatatgtttattangcaggatcatgaattaattgacccatttccggtacctctggtcataattggaagtaaatatgatgtttttcaggtaagctcttccgcttctagctgagtttgttgtacatatatggctgtgctttttatgagggaggtacaaaaataatatcaaaataagaaaaataattattgaaggaatcggttaagtcatgcatcttaaagattttggaaaagacatagttgggacagga

SEQ ID NO: 57319 - DNA, 392 bp, Homo sapiens
  misc_feature 2, 7, 42, 49, 50, 64: n = A,T,C or G
cntgganaaccttaccttgtttgctgctaaaatactcaagangtttgcnntttttaaacaaccngtccctgtgatacaactttgaaaaaacttttaaaaatctctgatgtatgggctctttttttcccataagaattatgtacatctgtgatgttttacagggggatccgcttttaaacagtgtacatattggaccacactgaaatgtcatatatcctttctctacttaaaattggttatttacttgtgagttcatttccgatgtgttcttggttgttgctgttttctgcctgaagacgtgtatcataaagagctacatggtatggactatttatttgtaatttgacataaagtttgaagaataaagatctataaaagttgaagtttctgat

SEQ ID NO: 57320 - DNA, 377 bp, Homo sapiens
agaagcaggttaaatgaagtcttgtgaatttgtaatagatcagtaccatttattggtttggggaccatcttaattaaaaataaatgcccaaaatgtagaactttaaccaaagacttgtcccttttaaagcaaaatggggattgaagggacttataatttctgttgtttctaattaaagtccctgaagatcatataccaaagtgtttgagaacttcatccaaacctactttaaagcattatgtgcaattaagttgttatgacataattatattgcctaattgttgggtcttttttcttgagcttataatgtacctggaaaataaacctcttgagaaaaagaaaagttcatactgattattggaaaaggactatatatg

SEQ ID NO: 57321 - DNA, 391 bp, Homo sapiens
tatggccgggatacatcattcattcaagggctaaatttatattttttggaaatcatggcaactacacaggatgttgcttaccaggacggagttttggtatcttagtactgaagttagcactatgtttacatgcaaaagattaaggaaaaaacccttaaagtggacaggtatccaaagttcattttctgtgactcatcaaagtgacaaaagacttgtaacaactttgcctggacttttttcattttacaacagttcatccattcacaatgattttgttctctgctccatattttttaatcccttaagcatttgatgaaacactctttagtgctatatgcattttcttacttttgttaaaaatgtgacaattgtcaaaaaatgcactaaaatg

SEQ ID NO: 57322 - DNA, 374 bp, Homo sapiens
gctttttctttttgaggaagacgcggtcgtaagggctgaggatttttggtccgcacgctcctgctcctgactcaccgctgttcgctctcgccgaggaacaagtcggtcaggaagcccgcgcgcaacagccatggcttttaaggataccggaaaaacacccgtggagcccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccag

SEQ ID NO: 57323 - DNA, 397 bp, Homo sapiens
  misc_feature 2, 52: n = A,T,C or G
tntggcccgggggtgtgggctgggaggtctggtagggctgagcttgcaagangatcaacatgcctttggctagagatttactacatccgtccttggaagaggaaaagaaaaaacataaaaagaaacgcctagtacaaagtccaaattcttactttatggatgtaaaatgtccaggttgctacaagatcaccacggttttcagccatgctcagacagtggttctttgtgtaggttgttcaacagtgttgtgccagcctacagggggaaaggccagactcacagaagggtgttcatttagaagaaagcaacactaatgattcaaacagcttcctgaattttaattttgtgttgtctcacagaaagccttatcataaattccataattctaattaattta

SEQ ID NO: 57324 - DNA, 256 bp, Homo sapiens
  misc_feature 256: n = A,T,C or G
gagcacggttcgtttttcctttagtaggaaggacgttggtgttgagcatacgtatcaaggacagtaactaccatggctcccgaagttttgccaaaacctcggatgcgtggccttctggccaggcgtctgcgaaatcatatggctgtagcattcgtgctatccctgggggttgcagcctttgtataagtttcgtgtggctgatcaaagaaagaaggcatacgccagaatttctacagaaaacctacgatgtcattgn

SEQ ID NO: 57325 - DNA, 371 bp, Homo sapiens
  misc_feature 12: n = A,T,C or G
atggcgaaggcncccagctgctgaaggaggccgaggaagaattctggtaccgtcagcatccacagccatacatcttccctgactctcctgggggcacctcctatgagagatacgattgctacaaggtcccagaatggtgcttagatgactggcatccttctgagaaggcaatgtatcctgattactttgccaagagagaacagtggaagaaactgcggagggaaagctgggaacgagaggttaagcagctgcaggaggaaacgccacctggtggtcctttaactgaagctttgccccctgcccgaaaggaaggtgatttgcccccactgtggtggtatattgtgaccagaccccgggagcggcccatgtag

SEQ ID NO: 57326 - DNA, 381 bp, Homo sapiens
agtaaagtccataatttctggagtcagtttttcataacaagtttatggaatacatcatcattggcttcttcataatatatttattatgagtgaccaaattttgcctggaggagcaaaatgctcaaaacttgttattataggttaatttccagctcactgttgacactgaaagattctgtgttactttaaacccaggataaaaggctggaaaaaaaattaaatgtaagtcataaactagtactcagcttttcctagtttctaaggcttattaacatttgcaaattactcaataaatgtctttcataatggaataacataaaagcttttgatttggcggatagtgatattttatttttatttttcattctggttgaaaaaaat

SEQ ID NO: 57327 - DNA, 381 bp, Homo sapiens
  misc_feature 28, 283: n = A,T,C or G
tatggccggggaggcattgaggcagccngcgcggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgatggaggttgagatgaancttcttcatggagtaaaaaaatgtatttaaaagaaaattgagagaaaggactacagagccccgaattaataccaatagaagggcaatgcttttagatt

SEQ ID NO: 57328 - DNA, 187 bp, Homo sapiens
  misc_feature 17: n = A,T,C or G
accagaactttgcgaancgctacgccatggtttatggatacaatgctgcctataatcgctacttcaggaagcgccgaggggccaaatgagactgagggaagaaaaaaaatctctttttttctggaggctggcacctgattttgtatccccctgtagcagcattactgaaatacataggcttatatac

SEQ ID NO: 57329 - DNA, 282 bp, Homo sapiens
tatggtaaggtaacattgctttgttgtacttttgaacaagagctcctcctgatcactattacatatttttctagaaaatctaaagttcagaagagaatgtatcgctgctgacttttattccaatatttggatggagtaagttttagggtagaattttgttcagtttggatttaatcttttgaaaagtaaattccttgtttactggtttgactataattctctgttatctttacgaggtaaaactgcaagctgactagcatgttctgtgaatctgccattcct

SEQ ID NO: 57330 - DNA, 389 bp, Homo sapiens
  misc_feature 2, 4: n = A,T,C or G
ananttgtattcgatagaccactgcctgtgtctcgtcttgtatctctaattggaagcaagacccagataccaacacaacgatatggccggagaccatatggtgttggtctccttattgctggttatgatgatatgggccctcacattttccaaacctgtccatctgctaactattttgactgcagagccatgtccattggagcccgttcccaatcagctcgtacttacttggagagacatatgtctgaatttatggagtgtaatttaaatgaactagttaaacatggtctgcgtgccttaagagagacgcttcctgcagaacaggacctgactacaaagaaatgtttccattggaattgttggtaaagacttggagtttacaatctatg

SEQ ID NO: 57331 - DNA, 397 bp, Homo sapiens
  misc_feature 8, 39, 50, 56, 71, 72, 97, 110, 177: n = A,T,C or G
cccgggangtttaagttagggggcctgcccctttaagcntagtcccaccntgaaanacactccccttgaanntctctaaaccttaactttctggccnttttgtttcaganatgcctaaccctcagggggtcttttgttctctacgcctaaaaacttaatctgtttggaacaattccntttcctctctgtagaaattgacctggccatggctcctgtgaatgatacggttgctattatccctgaacactgtaaaaatgaactttgaaacagttgggtaggacccaaacagaaaatgatgtatggcttggaaatagtttagctgaacattatgctttaatattttactggccattgcagcacaggtttagaaatttatgttcggctttttaaagtttta

SEQ ID NO: 57332 - DNA, 198 bp, Homo sapiens
  misc_feature 4, 8, 42, 59, 60, 100, 104: n = A,T,C or G
cgancaanttgttggtgaccaagtttgccttgtttggaaganaagtctgatacccctannttaagataaaagtgggagaagggaatagccctacttttanttantttttcttaacttttatcttgtaaagtcattgttttcaaagcccaaagcacccatggaaacttcttcactgattctaagagcattaaatatttc

SEQ ID NO: 57333 - DNA, 400 bp, Homo sapiens
  misc_feature 3, 20, 27, 31, 64: n = A,T,C or G
gantaactggccgcgggacnccggtcntctntggcccgggggagtgtgaaatcttcgagaagantttctctttagttctttgcaagaaggtagagataaagacactttttcaaaaatggcaatggtatcagaattcctcaagcaggcctggtttattgaaaatgaagagcaggaatatgttcaaactgtgaagtcatccaaaggtggtcccggatcagcggtgagcccctatcctaccttcaatccatcctcggatgtcgctgccttgcataaggccataatggttaaaggtgtggatgaagcaaccatcattgacattctaactaagcgaaacaatgcacagcgtcaacagatcaaagcagcatatctccaggaaacaggaaagcccctggatgaaaca

SEQ ID NO: 57334 - DNA, 387 bp, Homo sapiens
  misc_feature 6: n = A,T,C or G
aaggangaggtgattaaggaagtccaggagttttacaaggacacctacaacaagctgaaaaccaaggatgagccccagcgggaaacgctgaaagccatccactatgcgttgaactgctgtggtttggctgggggcgtggaacagtttatctcagacatctgccccaagaaggacgtactcgaaaccttcaccgtgaagtcctgtcctgatgccatcaaagaggtcttcgacaataaattccacatcatcggcgcagtgggcatcggcatttgccgtggtcatgatatttggcatgatcttcagtatgatcttgtgctgtgctttccgcaggaaccgcgagatggtctagagtcagcttacattccctgagcaggaaagtttacccca

SEQ ID NO: 57335 - DNA, 398 bp, Homo sapiens
  misc_feature 6, 24, 27, 29, 49, 53, 61, 62, 73, 76, 90, 104: n = A,T,C or G
tacttngccgcgggaacactcggntantntggcccggggtaaaaaggcnaccntttaattnntttgcaaagcnccntaagagccaaagangtaatttttcttgnaattgtaaatctttttgtgtctcctgaagacttccctttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcac

SEQ ID NO: 57336 - DNA, 322 bp, Homo sapiens
  misc_feature 6, 12, 29, 31, 34, 43, 184, 188, 237, 243: n = A,T,C or G
tccccnttttantaaattaaccccaaganantantcccaccantacaaggtcaggggtggggaagagtattaatggtatcttaattattacccagtctggttttttttttaaatggggtaaaaatcaaatgcaaccccatcttgttttaggaattttgagaactaataaatgcaccttaatggncagngttcctttcaaacatgtgagttctttaacaaaaatgaaataaaccaggngtctgngatttctaattaatcaccgctggccattacacaggttttgttgtttggggtggggagggggcttttgttcccttttgac

SEQ ID NO: 57337 - DNA, 377 bp, Homo sapiens
gtctaccttcataacaacaatatctctgtagctggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgtctacaataaaaagaaattttgcctg

SEQ ID NO: 57338 - DNA, 286 bp, Homo sapiens
  misc_feature 17, 23: n = A,T,C or G
acctgatgagtacaaantaatcntcagaaccaaactcaaatatgactcagatgttggaattatcagacatgtaatttaaaacaattatgatcaatatgtgaaagacgttgatggaagaggtagacaacacataagaaaatggatgtcagcagaaagatgaaaagaaatgccagtaatacaaaacagacaaagaaatgaataattttttattgggctcatatgtagatttgacatggctgaagaatcagtgaccttgaggataggtgaagggaaatgacccaaactg

SEQ ID NO: 57339 - DNA, 391 bp, Homo sapiens
  misc_feature 41: n = A,T,C or G
tatggccgggggcatttaagaggcatcctctgccaagaccnaaaggaaagaagaaaaagggccaaaagccaaaatgaaactgatggtacttgttttcaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgcccaaaagacgttttctttggaccaaagatctctttcgtgattccttgcaacaatcaatgagaatcttcatgtattctggag

SEQ ID NO: 57340 - DNA, 370 bp, Homo sapiens
ggggcgcccagctgccaacaccaagattggcccccgccgcatccacacagtccgtgtgcggggaggtaacaagaaataccgtgccctgaggttggacgtggggaatttctcctggggctcagagtgttgtactcgtaaaacaaggatcatcgatgttgtctacaatgcatctaataacgagctggttcgtaccaagaccctggtgaagaattgcatcgtgctcatcgacagcacaccgtaccgacagtggtacgagtcccactatgcgctgcccctgggccgcaagaagggagccaagctgactcctgaggaagaagagattttaaacaaaaaacgatctaaaaaaattcagaagaaatatgatgaaagg

SEQ ID NO: 57341 - DNA, 375 bp, Homo sapiens
  misc_feature 23: n = A,T,C or G
gaccgctgttcgctctcgccgangaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgcttgaccttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagt

SEQ ID NO: 57342 - DNA, 277 bp, Homo sapiens
  misc_feature 2, 19, 36: n = A,T,C or G
antgtcaagtaatatttantgagcttcccctcaganaggcatttagcatcatgatggcacccatcctctaacaataatgggaaggctattttccactgttattaatcattaattctccaaatcattttagtattattattaattctaataagtacagagattaataaatgcattcaaaccacatgtgaatatttgctataggtttatctgtgcctactgtatgttcagatttttctttatatctgaactttgttataaataaatgacagtaaaagtg

SEQ ID NO: 57343 - DNA, 368 bp, Homo sapiens
  misc_feature 72: n = A,T,C or G
atgtacagttatctaagttaatttaaagttgtttgtgcctttttatttttgtttttaatgctttgatatttnaatgttagcctcaatttctgaacaccataggtagaatgtaaagcttgtctgatcgttcaaagcatgaaatggatacttatatggaaattctgctcagatagaatgacagtccgtcaaaacagattgtttgcaaaggggaggcatcaagtgtccttggcaggctgatttctaggtaggaaatgtggtagcctcacttttaatgaacaaatggcctttattaaaaactgagtgactctatatagctgatcagttttttcacctggaagcatttgtttctactttgatatgactgtttt

SEQ ID NO: 57344 - DNA, 298 bp, Homo sapiens
  misc_feature 9, 17, 28, 42, 43, 52: n = A,T,C or G
tggcccgangagaaganccccgtttgancagttagccttttnncgaagagcnttttttcactgatggttgtcaatcgtctgacccgaagaactcggctgtgatgagattattgatagagagtagttagatgctgttaaaagaggaggaaactacttgaggagggacccaactttccgctatcttttgggttcattccaaatagttttgtgccattgaaaaacttgaccttcaaaaaaatttgtttttcagaatagaacacaataggacagtggctgcacagttgtgaaaaaggaagag

SEQ ID NO: 57345 - DNA, 143 bp, Homo sapiens
gagccatgcagaggttattccagctctggtcacccgactcctttcaccaaattgctcctaactggaagatctcactttccccttgtggggtaggaaccgatgccagtgggagggatgtgcccctgaccattaacgactgtttt

SEQ ID NO: 57346 - DNA, 398 bp, Homo sapiens
  misc_feature 2, 11, 28, 29, 33, 53, 66, 67, 71: n = A,T,C or G
anttctttaanccgggaaatctcggttnnttantggcccggggtcggctttantaggtgaaagagnnaganctgccaagcctcccaggatttcaaaatccttcctgcttaaggaactcagaaacaagtcagcgtctggccaacctcaggcaacgggtggagcagtttgccagggccttccccatgcctggttttgatgagcattgaaggcacctgggaaatgaggcccgcagactcaaagttactctccttccccctacctgggccagtgaaatagaaagcctttctattttttggtgcgggagggaagacctctcacttagggcaagagccaggtatagtctcccttcccagaatttgtaactgagaagatcttttctttttcctttttttggtaac

SEQ ID NO: 57347 - DNA, 386 bp, Homo sapiens
  misc_feature 2: n = A,T,C or G
anggaagttgtttcttacttcttttctctcttatttattaaccatggtctgagagttgtttttgttctatgtaacagtattgccacaaaactataggcaaatcgtgtttgcagggagatttctgatgcctctgtgggtgtgtgtaagttaaagtggccacatttaagaaggccaagctttgtagtggttgcacagtcacactgatatgctgatttgctctttctcattgtatgtctatgctttgtcatcagtgctatagtaaattacaaagaaataggtagattgtatgaacatacccacaaatgcctatgatttaggttaccaatgtattctttctcatttggggttttgcttctgtctgtctgtttattggaaacttgtacttc

SEQ ID NO: 57348 - DNA, 360 bp, Homo sapiens
  misc_feature 7: n = A,T,C or G
ggaaganggcggcctcagcagcgcgaggtgctgtggcgctgcgtagaagtatcaatcagccggttgcttttgtgagaagaattccttggactgcggcgtcgagtcagctgaaagaacactttgcacagttcggccatgtcagaaggtgcattttaccttttgacaaggagactggctttcacagaggtttgggttgggttcagttttcttcagaagaaggacttcggaatgcactacaacaggaaaatcatattatagatggagtaaaggtccaggttcacacctagaaggccaaaacttccgcaaacatctgatgatgaaaagaaagatttttgagactgcagcctattaataaagtta

SEQ ID NO: 57349 - DNA, 383 bp, Homo sapiens
  misc_feature 360: n = A,T,C or G
gagtataatgtctcataatatcatattgtgttgtgcatggtcattcagctgttttagaatatgttcttatattacaataaatgatacccttacttacatagtcaaaagttgtgctgccttatttgtaaattcgttaagtgttagcttgagattaaagagttaaaagcagaagtactaacaaagagccctattcttcaaactgaatcttctgttaaagaatttgagttttgaagttgctaaagcaatgcagtgaacagtgtaccagaccatagtattagacacaggtcttgctcacagggttcttgccataaagtagacaagttatgtctgctgatcaatctctttaagagaggaattggngtcaacatggtgcaaaacaaaat

SEQ ID NO: 57350 - DNA, 266 bp, Homo sapiens
  misc_feature 5, 15, 107: n = A,T,C or G
tggcncggggatgancatgactgtccccaggccctgtctcccctgaagcgtctgtgctgtcaggacagccctgggcagagatgaggcaggggtgaggcgtgcgtgtncttttcctccttgttggatgtcttccatatcatctgtttccatagctacaatccatcccttggccttaactttggaatttggagattatatgcaaacatgtgtaaaggctcatgaatatggatgacactggaattttataaattctaaaataaaacccg

SEQ ID NO: 57351 - DNA, 387 bp, Homo sapiens
  misc_feature 2, 12: n = A,T,C or G
anaccccaaggnactataaatcatgctgctatgaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaacaaaaaaccaaacaccgcatattctcactcataggtgggaattgaacagtgagatcacatggacacaggaaggggaatatcacactctggtgactgtggtggggtcgggggagggggggggatagcattgggagatata

SEQ ID NO: 57352 - DNA, 379 bp, Homo sapiens
  misc_feature 2, 35: n = A,T,C or G
tnttatggccaggggatggcaatcgcatcctcagnaaaccagtcttccaccggatatgtatgaatgtctacgtgttgctaacgaagccactcttaattaatatctgtatcctggaacaatattttatggttatgtttttctgtgtgtcaagttttcatagtatccatattttattactgtttattacttccatgaattttaaaatctgagggaaatgttttgtaaacatttattttttttaaagaaaagatgaaaggcaggcctatttcatcacaagaacacacacatatacacgaatagacatcaaactcaatgctttatttgtaaatttagtgtttttttatttctactgtcaaatgatgtgcaaaaccttttactg

SEQ ID NO: 57353 - DNA, 359 bp, Homo sapiens
  misc_feature 1, 21, 28: n = A,T,C or G
naatgcactttggtgatcagnaatcagnaagttcggatttgaagttggtcctgtttgttttcttggctaagattaagacaaagaacatatcaaatcaacagaaaatataccttggtgccaccaacccattttgtgccacatgcaagttttgaataaggatggtatagaaaacaacgctgcatatacaggtaccatttaggaaataccgatgcctttgtgggggcagaatcacatggcaaaagctttgaaaatcataaagatataagttggtgtggctaagatggaaacagggctgattcttgattcccaattctcaactctccttttcctatttgaatttctttggtgctgtagaaaac

SEQ ID NO: 57354 - DNA, 378 bp, Homo sapiens
  misc_feature 17, 19: n = A,T,C or G
gtaccaccagcaccagnantgtatattaaggtgtggctttaggagcagtgggagggtaccagcagaaaggttagtatcatcagatagcatcttatacgagtaatatgcctgctatttgaagtgtaattgagaaggaaaattttagcgtgctcactgacctgcctgtagccccagtgacagctaggatgtgcattctccagccatcaagagactgagtcaagttgttccttaagtcagaacagcagactcagctctgacattctgattcgaatgacactgttcaggaatcggaatcctgtcgattagactggacagcttgtggcaagtgaatttgcctgtaacaagccagattttttaaaatttatattgtaaatattg

SEQ ID NO: 57355 - DNA, 253 bp, Homo sapiens
  misc_feature 15, 38, 40: n = A,T,C or G
gtccgggaaaaaccncgcattcgaaatccatgcagtgntntatatttttctaagttttggaaagcaggttttttcctttaaaaaaattatagacacggttcactaaattgatttagtcagaattcctagactgaaagaacctaaacaaaaaaatattttaaagatataaatatatgctgtatatgttatgtaatttattttaggctataatacatttcctattttcgcattttcaataaaatgtctctaatac

SEQ ID NO: 57356 - DNA, 388 bp, Homo sapiens
  misc_feature 9: n = A,T,C or G
gggactagnaatgcgagcttcttaacagcttatctcttttatttgcagatattagactggttatatgaaaacttaccgttacaaaatgatgttttcttaacccaagtaaataaaatagaatgaactatatataatatatataatgaactatatataattcttcaagattctaatgcatgcttgtttagagcttgctgttaacctaagcaatgagatagcaatccctttcattatttgttgactccccttaatagagtacctaatgaacattgccaacttaagaaaaaaatgtttttttttctgcaatgtcagctctgaaattcagctttgttgcctctttataggacaattgcaggcgagctgaaaatgttcttcgtttatggatcat

SEQ ID NO: 57357 - DNA, 323 bp, Homo sapiens
  misc_feature 6: n = A,T,C or G
aattcnagtcgctttaggaaatgatgcttatgcagggtacttcgttcaagaccggcgcttggcacccttgttggaaagggattttcagcataacattttccttccacctctttgaccttccctccagcgttggccaaattgtgctgaggaagatgcatcaagggcttggctgtgccttcataggtcatctagggttttataaaggaggaggagacaatattttttcaaactttttggggagtggggtcatttctgtatataaaaaatgttaatatttaaggtgtatttatgttaccgttctgaataaacagaatggaccattg

SEQ ID NO: 57358 - DNA, 385 bp, Homo sapiens
  misc_feature 1: n = A,T,C or G
ntaagcaaacaaaatttaaaggattatataacatgatcaagtgaaatttaaccttaggatgcaaggatgattacacatatgcaaatcaataaatgtaacacaccacattagcagaataaagtataaaaatcatacgattatctcagtaaatacagaaagggaacttgacaaaacccaacattatttcataattaaaaaaaatctcaacaaacttgctgtacaagacataacctcaacataataaagactttgcgtgacaaacccacagttaacatactcattggtgaaagttgaaagctttgcttctgagattaggaacaagacaaggaagcccacttttgtcatttctagtcaatatagtcttggaagtcttagaatagttagg

SEQ ID NO: 57359 - DNA, 322 bp, Homo sapiens
  misc_feature 161: n = A,T,C or G
tcgttacaggcctggtactgtggcgctccgtgaaattagacgttatcagaagtccactgaacttctgattcgcaaacttcccttccagcgtctggtgcgagaaattgctcaggactttaaaacagatctgcgcttccagagcgcagctatcggtgctttgnagggaggcaagtgaggcctatctggttggcctttttgaagacaccaacctgtgtgctatccatgccaaacgtgtaacaattatgccaaaagacatccagctagcacgccgcatacgtggagaacgtgcttaagaatccactatgatgggaaacatttcatt

SEQ ID NO: 57360 - DNA, 379 bp, Homo sapiens
  misc_feature 22: n = A,T,C or G
ggggccttgcgccgttgaaganaaagatgctggtttcgagttttggagatccttgttttttatggaacacagttctgtaaaattttcataagattccttggcaataacatacgcttgtgatggaccctagaaatactgctatgttaggattgggttctgattccgaaggtttttcaagaaagagtccttctgccatcagtactggcacattggtcagtaagagagaagtagagctagaaaaaaacacaaaggaggaagaggaccttcgcaaacggaatcgagaaagaaacatcgaagctgggaaagatgatggtttgactgatgcacagcaacagttttcagtgaaagaaacaaacttttcagagggaaatttaaaatt

SEQ ID NO: 57361 - DNA, 220 bp, Homo sapiens
  misc_feature 161: n = A,T,C or G
gagcaggaattcttccgtcatgatccacagtctctgttgggttgcagtagtcaccgcgatgctcataaactgagaaaaaatatatatatgtctttttcactttattggcaaatattacataagtatataaatttcactttttacagctaaaggctgcatanccataacttctgagcaatttattaaggttgaataaaattgatataaggaatcattttat

SEQ ID NO: 57362 - DNA, 386 bp, Homo sapiens
  misc_feature 69: n = A,T,C or G
tatggccggggaatagctgatattttgataacaatctctaatttgcatgggcacccacatttcttctanttaaaagaattagtgttttggcttctgtactgcttatggttgtaggattcaggggttaatggaatcacagaaatgatattctgcaagaatttcttttaaataaaaagtttgggggtgcaatataagaagtttatataatatgcagtacattatccaaaagagaaggtagttaatgcagtagaaagtagtggtaataattcctttttaaaaaaatttcggtagtcatatagtaacattttgctatatgaaaactttggtatattctgtggttacaactaagattgtgtctggcagctcttttttggggatgtgtgtgt

SEQ ID NO: 57363 - DNA, 387 bp, Homo sapiens
gtgttctgtttgaaactaatacttaccgagtcagactttgtgttcatttcatttcagggtcttggctgcctgtgggcttccccaggtggcctggaggtgggcaaagggaagtaacagacacacgatgttgtcaaggatggttttgggactagaggctcagtggtgggagagatccctgcagaacccaccaaccagaacgtggtttgcctgaggctgtaactgagagaaagattctggggctgtgttatgaaaatatagacattctcacataagcccagttcatcaccatttcctcctttacctttcagtgcagtttcttttcacattaggctgttggttcaaacttttgggagcacggactgtcagttctctgggaaagtggtcagc

SEQ ID NO: 57364 - DNA, 341 bp, Homo sapiens
gtgtgtgtgtatgtgtatctcacactcatgcattgtcctctttttatttagattggcagtgtagggagttgtgggtagtggggaagagggttaggagggtttcattgtctgtgaagtgagaccttccttttacttttcttctattgcctctgagagcatcaggcctagaggcctgactgccaagccatgggtagccttgggtgtaaaacctggagatggtggatgatccccacgccacagcccttttgtctctgcaaactgccttcttcggaaagaagagggtgggaggatgtgaattgttagtttctgagttttaccaaataaagtagaatataagaaga

SEQ ID NO: 57365 - DNA, 386 bp, Homo sapiens
ggtgaatgaattgaaatcaaaagaatctgacatcatgacaacaaatggtgtaattcatgttgtagataaactcctctatccagcagacacacctgttggaaatgatcaactgctggaaatacttaataaattaatcaaatacatccaaattaagtttgttcgtggtagcaccttcaaagaaatccccgtgactgtctatagacccacactaacaaaagtcaaaattgaaggtgaacctgaattcagactgattaaagaaggtgaaacaataactgaagtgatccatggagagccaattattaaaaaatacaccaaaatcattgatggagtgcctgtggaaataactgaaaaagagacacgagaagaacgaatcattacaggtcctg

SEQ ID NO: 57366 - DNA, 376 bp, Homo sapiens
attggaaagcagttagaaaaatgagaaaatttttagatgagcaagccattgacagagaacgtgagagagatgtattccaacaggaaatacagaaactagaacagcaacttaaggttgctcctcgattccagcctatcagtgaacatcaaactagagaggttgaacagttagcaaatcatctgaaagaaaaaacagacaaatgcagtgagcttttgctctctaaagagcagcttcaaagggatatacaagaaaggaatgaagaaatagagaaactggagttcagagtaagagaactggagcaggcgcttcttgtgagtgcagatacttttcaaaaggtagaggaccgaaaacactttggagctgtagaagctaaacc

SEQ ID NO: 57367 - DNA, 385 bp, Homo sapiens
gtgtccttagtgatgtgtgtgtgtctccatgcacatgcacgccgggattcctctgctgccatttgaattagaagaaaataatttatatgcatgcacaggaagatattggtggccggtggttttgtgctttaaaaatgcaatatctgaccaagattcgccaatctcatacaagccatttactttgcaagtgagatagcttccccaccagctttattttttaacatgaaagctgatgccaaggccaaaagaagtttaaagcatctgtaaatttggactgttttccttcaaccaccattttttttgtggttattattttttgtcacggaaagcatcctctccaaagttggagcttctattgccatgaaccatgcttacaaagaaagca

SEQ ID NO: 57368 - DNA, 243 bp, Homo sapiens
  misc_feature 3, 11, 44: n = A,T,C or G
gantctggaanctttgatcccccgcagtcatgatgttagactcnttgaaaagaatgtattttctaatgcatgatgcgatcggtctatagatgtgtcatggaaacttggttgcaacttcaagacaaaataaaaagtaaacatttacatgaaaaatggtggatatggaaggtggagaagagaggagataacagctttatctttcaaaatagagaattgagagatggtaccaaaagctgatgaagt

SEQ ID NO: 57369 - DNA, 371 bp, Homo sapiens
gagttggggagcgcagatcccgaacagcgctgggagcgtaagtgcgggcagagcactgcgccgtttgggaacgcaactttgaggagacagtgcggtggacttcagtgaagttccttatgacttcccctgaaattgcttccttatcatgggggcaaatgaaagtaaaaggctctaatacaacctataaggactgcaaagtatggccagggggtagtcggacttgggattggagagaaacaggaactgagcattctcctggtgtgcagcctgcagatgtgaaggaagttgttgagaagggtgtacagactcttgtgattggccgagggatgagtgaggccttgaaggtgccttcatcaactgtggagtacctc

SEQ ID NO: 57370 - DNA, 372 bp, Homo sapiens
gattgaggcagccagcgcggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatg

SEQ ID NO: 57371 - DNA, 218 bp, Homo sapiens
  misc_feature 37, 82: n = A,T,C or G
tatggccggggaaaagtaaatcttaccccaataaatntaaaaaaatcttgtcagttacttttcttttacatattttgctgtncaaaattgttttatatcttgagttactaactaaccacgccgtgttgttcctatgtgcttttctttcattttcaattctggttatatcaagaaaagaataatctacaataataaacggcatttttttttgattctgt

SEQ ID NO: 57372 - DNA, 381 bp, Homo sapiens
gagaaatcatctagacagaaaatcaataaagtaaacagtggatttgaacaacactagacaaaatggacctgatatacagaacattccattcaacagtagcagaatatgcacatttttctcactcaaacatgtaacattctccaggacagattatttgttaggccacaagataagttttaacaaatttaaaattaaaattatatcaagtatgttttctgtcaacagtggcatgaaaccataaatccgtaacaggaggaaaattggaaaattcacaaatatgtggaaattaagcaacacactcctgaacaaccaaaggtcaaagaagaaatgaaaggggaagtaaaaaatatcttgaaacaaacaaaaatggaaacataacat

SEQ ID NO: 57373 - DNA, 376 bp, Homo sapiens
  misc_feature 22: n = A,T,C or G
tatggccgggaactgtcccggngacaatgacatctttgaatcgctgtactacaggaagatgtacggagacatggcatgaagccagagagtgagagacattaactcattagactggaacttgaactgattcacatctcatttttccgtaaaaatgatttcagtagcacaagttatttaaatctgtttttctaactgggggaaaagattcccacccaattcaaaacattgtgccatgtcaaacaaatagtctatcaaccccagacactggtttgaagaatgttaagacttgacagtggaactacattagtacacagcaccagaatgtatattaaggtgtggctttaggagcagtgggagggtaccagcagaaaggtta

SEQ ID NO: 57374 - DNA, 124 bp, Homo sapiens
  misc_feature 2, 10, 15, 16, 20, 42, 45: n = A,T,C or G
cnaattttantgtannagangtttgcaaatacttactgctantantgtaaataccctaactgtattctgtagtgtatatgtaatactatttatgccccaataaatgttttaattctttctgacc

SEQ ID NO: 57375 - DNA, 376 bp, Homo sapiens
  misc_feature 7: n = A,T,C or G
accaagnagagttgaatccctgaatagaccaataacaggttctgaaattcaggcaataattaatagcctaccaaccaaaaaaagtccaggaccagatggattcacagccaaattctaccagaggtacaaagaggatctggtaccattccttctgaaactattccaatcaacagaaaaagagggaatcctccctaattcattttttgaggccaacatcatcctgataccaaagcctggcacagacacaacaaaaaaagagaattttagaccaatatctctgatgaatatcgatgcaaaaatcctcaataaaatactgggaacccgaatccagcagcacatcaaaaagcttatccaccaggatcaagttggcttcatc

SEQ ID NO: 57376 - DNA, 354 bp, Homo sapiens
tatggccgggagtgaaaaaaaggaatgacttcgtagagtacttttataattcagaaaagtattttaaatgcagaaattgtttttaatgtggaagtttatttcatattacttttttagtcatttgactccagttagtggaaaaaacaccaaactttaagccagaaattttggaattaagcctctaaaatacttgtgaggccttaggtaatgtttggggcttttagttatctataaaattgagggtattgaactaatatccaaagacataatactttctgtagtgttaacgctaaagggaatgtgaataactagggtttcagccagctttcaatctggatggcagtaaacaatgtc

SEQ ID NO: 57377 - DNA, 369 bp, Homo sapiens
  misc_feature 5: n = A,T,C or G
gaganctgaaattctgcctcctgaactcaagagtggagaatactgggttgaccctaaccaaggatgcaaattggatgctatcaaggtattctgtaatatggaaactggggaaacatgcataagtgccaatcctttgaatgttccacggaaacactggtggacagattctagtgctgagaagaaacacgtttggtttggagagtccatggatggtggttttcagtttagctacggcaatcctgaacttcctgaagatgtccttgatgtgcagctggcattccttcgacttctctccagccgagcttcccagaacatcacacatcactgcaaaaatagcattgcatacatggatcaggccagtggaaatgt

SEQ ID NO: 57378 - DNA, 382 bp, Homo sapiens
  misc_feature 381: n = A,T,C or G
ggggaagggtttgaattgttttctttaaagagtaatgtccctttcagagacagctgatacttctttaaaaaaatcacaaaaatttgaacactggctaaagataattgctatttatttttacaagaagtttattctcatttgggagatctggtgatctcccaagctatctaaagtttgttagatagctgcatgtggcttttttaaaaaagcaacagaaacctatcctcactgccctccccagtctctcttaaagttggaatttaccagttaattactcagcagaatggtgatcactccaggtaggtttggggcaaaaatccgaggtgcttgggagttttgaatgttaagaattgaccatctgcttttattaaattttgttgnc

SEQ ID NO: 57379 - DNA, 388 bp, Homo sapiens
  misc_feature 9: n = A,T,C or G
atacaaaanagaacaactgcagcagattctaaaaaggaagaataagcaggcttttttagatgagctggagagttctgatctccctgttgctctgcttttggctcagcataaagatagatctacccaattagaaatgcaacttgagaaacccaaacctgtaaaaccagtgacgttttccacaggcatcaaaatgggtcaacatatttcactggcacctattcacaagcttgaagaagctctgtatgaataccagccactgcagatagagacatatggaccacatgttcctgagcttgagatgctaggaagacttgggtatttaaaccatgtcagagctgcctcaccacaggaccttgctggaggctatacttcttctcttgcttgtcac

SEQ ID NO: 57380 - DNA, 387 bp, Homo sapiens
gctctttttccggctggaaccatggagggtgtagaagagaagaagaaggaggttcctgctgtgccagaaacccttaagaaaaagcgaaggaatttcgcagggctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagctttcttcgccttcgtcaaatcttcaatggaacctt

SEQ ID NO: 57381 - DNA, 387 bp, Homo sapiens
  misc_feature 3, 4, 19, 26: n = A,T,C or G
agnngtacaggctgacagnagaagantcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaatttt

SEQ ID NO: 57382 - DNA, 375 bp, Homo sapiens
aactgggggatttatttataagggctctagaaaaaacgagttattcacaccagcatcatcttaactaacattctgaactagttagtgcagcttttcattgtgttgtgtggttggtctcataactaggttgagtttttctcctctgctgaggaaacagtaccgaagttctttttcttgtggcatttgtattataaaaacttggtgtgggggaggagcacaaaactccagcccactgaacctctgccaattaagatggtgttgggttaggttacatctggttactgtcctgggaaaatcatttttataggagatggccttccaagtggttttaaaatttactgaagtttttaggtcaattatgtatgttgactaaat

SEQ ID NO: 57383 - DNA, 376 bp, Homo sapiens
gaagaaaattaatgttctgacagttgtgatcgcctggagtacttttagacttttagcattcgttttttacctgtttgtggatgtgtgtttgtatgtgcatacgtatgagataggcacatgcatcttctgtatggacaaaggtggggtacctacaggagagcaaaggttaattttgtgcttttagtaaaaacatttaaatacaaagttctttattgggtggaattatatttgatgcaaatatttgatcacttaaaacctttaaaacttctaggtaatttgccacgctttttgactgctcaccaataccctgtaaaaatacgtaattcttcctgtttgtgtaataagatattcatatttgtagttgcattaataatag

SEQ ID NO: 57384 - DNA, 382 bp, Homo sapiens
actactcgtgtatgtgaactactgaagtaccaaggagagcactgtctcctaaaggaaatgcagcagtggtccattcctccatttcctgtaagtggccatgacatcagaaaagtgggcatttcttcaggaaaagaaattggggctctattacaacagttgcgagaacagtggaaaaaaagtggttaccaaatggaaaaagatgaacttctgagttacataaagaagacctaaaactgatggctactaaaaagcagagcatttctggtaagactaaattttctcccctccctcttaatgaggttttagagactacaccagaataaaagacagtttaggggacctctgtagaacaacaagggtcttattttgtgaattatatatt

SEQ ID NO: 57385 - DNA, 269 bp, Homo sapiens
aatccttgatgtgggcaagacctcctgaactagaacaaataggaatattttcatggaattttacctatttttataattattatttcttaaagtgattaaatgagaacatggatgagtggacttcatattatgactagctttactattttaattcaccttgcataactactgaattttgtcattcttgaaagtatgcaatttttattttggttatattacaaaaatgtcaatcaaatattaaaaaatagttaatgtgatagaaaaacctt

SEQ ID NO: 57386 - DNA, 262 bp, Homo sapiens
  misc_feature 2: n = A,T,C or G
anattcatcggcgtaaatctaactttcttcccacaacactttctcggcctatccggaatgccccgacgttactcggactaccccgatgcatacaccacatgaaacatcctatcatctgtaggctcattcatttctctaacagcagtaatattaataattttcatgatttgagaagccttcgcttcgaagcgaaaagtcctaatagtagaagaaccctccataaacctggagtgactatatggatgccccccaccctaccaca

SEQ ID NO: 57387 - DNA, 377 bp, Homo sapiens
gagtaaaacagaattctctttattcttttagtgaccactatactcattttgaaagagttgtgaaggctcttctgatcaacgctttagatgaatcttttctgggaacattatatgatggcacaaggcaaaaatcatatgcaaaagatatgctaacatctcttcattatttggataaccgctttgttcagcctcgtctagagagcttggtatcctagaagtcgttggaaagagcaatataaggagcgagtagaaaattattctaatgtaagtattcatttgaagaatcctgaaaactgttcctgccaggcttgtggactgcatcgctactgtaaatattcagtgcatttatcaggagagttgtataacaccaggaccat

SEQ ID NO: 57388 - DNA, 269 bp, Homo sapiens
atgccgtgactctgggctatatcagtttttggaaagcagggttcctctgcctgctaacaagcccacgtggaccagtctgaatgtctttcctttacacctatgtttttaagtagtcaaacttcaagaaacaatctaaacaagtttctgttgcatatgtgtttgtgaacttgtatttgtatttagtaggcttctatattgcatttaacttgtttttgtaactcctgattcttccttttcggatactattgatgaataaagaaattaaagtg

SEQ ID NO: 57389 - DNA, 365 bp, Homo sapiens
gtttccattctgggaaaagcccaaaccgaatacggtcagcagtcaactccagggtttgggcttgattcctgttgaataatagttttgagcattctttgtggttaaataaattcttaaatctgcctagttttgatgaattcttttgtgaaacttgaaagagaatagacagtatgacatatagaattaatacaaaacagtttaacaaccatttaactgcagtgtaagaaaattggactgtaatcatatcgctactggcatctgttatctagtatgcatttctggtgtgtatctgaaaggaagacattttctaccctagatccaattgcatttatttatcaataagtgccattaaattgaaattatat

SEQ ID NO: 57390 - DNA, 372 bp, Homo sapiens
  misc_feature 39, 209, 230: n = A,T,C or G
gaagaaaaagacaaaatcttcaaagccttcaaaaccagnaaaaagataaggagcccagaaaaggaaaaggaaaaagttcgaagaaatgaaaccatttttcactagcgacagccactttttactctccctcctgaccagtccggctggtctagagaaagccttgttttttcccagagcaaccatgttttagcataatgggatgacctggngtcccattataaataaagggnggtatggctagaagggtatgagcagtaggcttatgtacacctcttatagaggttgataggactgcttgggtcctccactgtcctctgtcaatctagttagacgtgcttctgaatgactgtagaattggaactagaaactaca

SEQ ID NO: 57391 - DNA, 287 bp, Homo sapiens
  misc_feature 20: n = A,T,C or G
gattttccagggaaaaaganagttttgtcccacagtcagcaggccactagtttattaacttccagtcaccttgatttttgctaaaatgaagactctgcagtctacacttctcctgttactgcttgtgcctctgataaagccagcaccaccaacccagcaggactcacgcattatctatgattatggaacagataattttgaagaatccatatttagccaagattatgaggataaatacctggatggaaaaaatattaaggaaaaagaaactgtgataatacccaatg

SEQ ID NO: 57392 - DNA, 382 bp, Homo sapiens
gataacaagcttaaaaacataccgactgtcaatgaaaaccttgaaaactattacctggaggtcaatcaacttgagaagtttgacataaagagcttctgcaagatcctggggccattatcctactccaagatcaagcatttgcgtttggatggcaatcgcatctcagaaaccagtcttccaccggatatgtatgaatgtctacgtgttgctaacgaagtcactcttaattaatatctgtatcctggaacaatattttatggttatgtttttctgtgtgtcagttttcatagtatccatattttattactgtttattacttccatgaattttaaaatctgagggaaatgttttgtaaacatttattttttttaaagaaaagatg

SEQ ID NO: 57393 - DNA, 246 bp, Homo sapiens
gaaacaaacttgtgttttaattttcatgattctagttgttcaacctgtttttttgacactctgtatctgcattcatttattcactaaaaagatgcttagtaaattgtaagtatcatgctaggcactgtgaattcattgataagatattctctctctctttttttcttttgagatggagtctctgtctgttgcccaggctggagtacagtgagccaagattacgccactgcactccagtctttctct

SEQ ID NO: 57394 - DNA, 463 bp, Homo sapiens
agaagctgggtcatattgaccatccagtaatggttgttaatgttgataactcagtaacagcaaaagtcagaaaagtggcaacagcaccacctgctccagcatataaagctgagacacattgaaaataaattagaagtagcccctacaagtacagctgtgtgtgattctgtcatggataccaagaagtcttctacaagtgctactcgaaaaataagtagaaaagatggtagatacctggatgattcttgggttaatgctccaatctccaaatccactaaatcacgaaaagagaaatctcgtagtcctctcagggccaccaccctggagagtaatgtgaagaaaaataatcgtgtggaatttcgtgaacctttggtttcttatagggaaatccatggtgcaccttccaatttcagttccagccatctggaatcaaagcacgtatactgtgtagatgttaatgaag

SEQ ID NO: 57395 - DNA, 189 bp, Homo sapiens
gatacaatggactttgggggaagtgtaaaagggggtgagggattaaagaccacacactgggtacagtgtacgctgtttgggtgatgggtgcatcaaaatctcagaaatcaccactaaagaacttatccatgtaaccaaacaccacctgttccccaataacctattgaaataaatgaagagaaagtaacc

SEQ ID NO: 57396 - DNA, 193 bp, Homo sapiens
aacaaaaaatctggaattaataagcattatagcggcattgcaggatacaaagttaatacacaaatgttcattgctgtataccaacaatgaacaagtggaatttgaaattcaaaacacaataccatttacgttaacacctcaaaattgaaatccttaggtataaacctaataaaatacatacaagatctacacc

SEQ ID NO: 57397 - DNA, 371 bp, Homo sapiens
atgaaggaataagttggaccaagggaagtcggggacgtaaaaaatgaagcaaaacaatgccagggtgtctcccgctttactcttcaggaatggtgtcccaagttggaggctttgtgtcagctgcaaatcctaccagttacgtccaagaatggctttccctcgggcaggtggcagcggccatctcccactgggaatatggcgtagtatctccggtccattccttggatgctaaggactgcgggaatgagggagtcagataaagaacaaacctcgaaacgaacagttaaattgaaatgctatgtgcctgacccaatggtaggcacatagtaggcactcaactcatatgtttaattgaattgaaaatatccctt

SEQ ID NO: 57398 - DNA, 238 bp, Homo sapiens
  misc_feature 76, 113: n = A,T,C or G
ggggttctgtgggtttgggtgggaagagggccatctgcctgaatgtaacctgctagctctccgaaggccctgcggncctggcttgtgtgagcgtgtggacagtggtggccgcnctgtgcctgctcgtgttgcctacatgtccctggctgttgaggcgctgtttcagcctgcacccctcccttgtctcatagatgctccttttgacctttgcaaataaatatggatggcgagctcctag

SEQ ID NO: 57399 - DNA, 336 bp, Homo sapiens
ggggtggggagaacacttaacaacatggggaccagtcaggggaatccccttatttctgttttgcatatgaggaaccctagagcagccaggtgaggctctctagtttaataaaaatcatggaaagactcttaatgcagactcttcttaagtgttaatagggattttttcagcttattttggttgcagtttccaatttttaaaaatgttgaggtaatctttcccaccttcccaaacctaattcttgtagatgcattagtgttgaaccaatgctttctcatgtctcaattctttgtatatgcattcttttcagatgtattaaacaaacaaaaacccttc

SEQ ID NO: 57400 - DNA, 109 bp, Homo sapiens
gggcccatggctcgcgcctacaatcccagcactttgggaggctgaggcaggcaaatcgtttgaggccaggagttcaagaccagcctggccagcacggcaaaactcatct

SEQ ID NO: 57401 - DNA, 324 bp, Homo sapiens
  misc_feature 39: n = A,T,C or G
atggccgagggtaaaagaagctccttccagcacctcctntcttctccttttgcccaaactcacccagtgagtgtgagcatttaagaagcatcctctgccaagaccaaaaggaaagaagaaaaagggccaaaagccaaaatgaaactgatggtacttgttttcaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatggg

SEQ ID NO: 57402 - DNA, 135 bp, Homo sapiens
gatgaagattcaccaaataagctatatactttggttacctatgtacctgttaccactttcaaaaatctacagacagtcaatgtggatgagaactaatcgctgatcgtcagatcaaataaagttataaaattgccc

SEQ ID NO: 57403 - DNA, 158 bp, Homo sapiens
ggatggggataggctggggtttctcagcctcggcactgttggcatttgggctggctcctcctttgtggtgggggctgtcctgtgggttgtaggacgtttagcaccatctctggcctcgacccaccagatgtcagtagcaccccccaattgtcaaaacc

SEQ ID NO: 57404 - DNA, 202 bp, Homo sapiens
  misc_feature 136, 138: n = A,T,C or G
gagactaacatggactaatctgtgggagcagtttattccagtatcacccagggtgcagccacaccagggactgtgttgaagggtgttttttttcttttaaatgtaataccttcctcatcttttcttcttacacagngnctgagaacatttacattatagataaagtagtaccatggggggtaacttctacttttaggaggac

SEQ ID NO: 57405 - DNA, 330 bp, Homo sapiens
  misc_feature 1, 2, 31: n = A,T,C or G
nnaatacaaaacctaacccttctggggtttnttgtggcggttgaaatagtcccacatgtggtcatcagaaaataagccattcctcataccaatataggatcagctccttgacctctgaggggcaggagtgcttcctggtgtgtgtattagaatcccttcctgccttgtttcatggcagtgaaatgcctcttggtcctgtccaagtgtatctttcactgatttctgaatcatgttctagttgcttgaccctgccacatgggtccagtgttcatctgagcataactgtactaaatcctttttccatatcagtataataaaggagtgatgtgc

SEQ ID NO: 57406 - DNA, 132 bp, Homo sapiens
  misc_feature 121: n = A,T,C or G
gttacctaatgttttactctcattttctttttctttatttttcatttgtaaaataggaacattaattgtactactttcaaaagaattaattgaagaaagagagatacagggtatctaggcngaggaagaccc

SEQ ID NO: 57407 - DNA, 127 bp, Homo sapiens
gtgtggcccaagctggtctcaaactcctgacctcaagcagttctcctacctcagcctctgacagtgctgggattagaagcatgagacatcacatccagctaagagttcagttcttttgaaaaatgcc

SEQ ID NO: 57408 - DNA, 386 bp, Homo sapiens
cttgtatgtatgttatggatacataaaatgcacgcaagccattatctctccatgggaagctaagttataaaaataggtgcttggtgtacaaaactttttatatcaaaaggctttgcacatttctatatgagtgggtttactggtaaattatgttattttttacaactaattttgtactctcagaatgtttgtcatatgcttcttgcaatgcatattttttaatctcaaacgtttcaataaaaccatttttcagatataaagagaattacttcaaattgagtaattcagaaaaactcaagatttaagttaaaaagtggtttggacttgggaacaggactttatacctcttttactgtaacaagtactcattaaaggaaattgaatga

SEQ ID NO: 57409 - DNA, 343 bp, Homo sapiens
gctgagctcagattcctctttcttgctggaggagatgagccaattcacagacacgtggaactctgtcactggctactctctcggtcttctggctcccccaacaatggtcctctcttattggaaagggaaaaggcaaggaaggaattaaaagaaatcctcatgttaaaattcttcttgttaaacaataagactctaaaaagtccaaaagtctacaaccagcaaccgtcatacttaatggtgcaacgttagaagcattctcttaaaaactggaaatgacaaagatgcgtggtagctttgtttctatttaaaaccaccaaaagctagaggtagtgcatttaagacc

SEQ ID NO: 57410 - DNA, 275 bp, Homo sapiens
  misc_feature 170, 274: n = A,T,C or G
taataaaagaactttacacatttgtaaaaaagaggttcttggtaagatataaaatggaaaaaggctaagtaatatgtgaatatcatatttttgaaaggtaaaaagtacatttgtatattacatatatggacataacttgtgaaggatgaaagaaagtacagcctctcggnggtgggattatgaatgatttttctccttttgcttgtttgtattttctatattcctaaaattaacacacattattattgctagaataataaaagttttataaaang

SEQ ID NO: 57411 - DNA, 449 bp, Homo sapiens
gggtgtccagtttgtctagtgattgttatttagagagttggaccactattgtgtgttgctaatcattgactgtagtcccaaaaaagccttgtgaaaatgttatgccctatgtaacagcagagtaacataaaataaaagtacattttataaaccatttactatggctttgtaacaattgcatacccatattttaagggacaggtgaatttactactttctaaagtttattgatacttcccttttatgtaaaatgtagtagtgatacctatatttccacattgtgcattgtgacacacttgtctagggatgcctggaagtgtataaaattggactgcatttcttagagtgttttactatagatcagtctcatgggccatctcttcctcagatgtaaatgatatctggttaagtgttatatggaataaaagtggacattttaaaaccaaaac

SEQ ID NO: 57412 - DNA, 151 bp, Homo sapiens
gggtcttgtaaaatgggagtaatacctacctcacagggttgttgtggggattaattagagataatgtctgtaaagcatttaaggttcttgaagaaggcactatataaatacaaaataatatctattaaagttggtttatttgtgaaaaaca

SEQ ID NO: 57413 - DNA, 473 bp, Homo sapiens
gcactactttttagaaatattgcatttaagttcaagatactttattagggtggaaaaaagaaaatactaagattgggaaaaagttaacaccaagtattgaaaaaataattattttgttcaatctaaaaactaaaattgtcttcctcattaaggaaaaagttaaaacatttaaagtagacatcacaaatattttcctagtttgtttgttttaaaatttgccacttattctatgtttgttttcttagacaattttaatatttttatctcagcaaaaaaagtaagtttgttataaattagcacagtttctttgggtcacagacaattgcaccaagttccaggcatcaatttctcatactttgtattggatttctataaaatgaacctggtggtagctgcaggaattgcaggcatagagatgaaattgctgatctcttatggaggatggcttataaataaaatttattttaattgac

SEQ ID NO: 57414 - DNA, 165 bp, Homo sapiens
  misc_feature 5, 165: n = A,T,C or G
ggacnaggaagtcgacgtgtgcagaagtcctggtaatctggtccttgttcccgtctggataccagcttccttcagcagcgcaggcggtggtccctgaggcccgtggaaggagtcaaacttgcgggaattttgcagaagtcattgtattcaaagaagaataagccn

SEQ ID NO: 57415 - DNA, 335 bp, Homo sapiens
  misc_feature 2: n = A,T,C or G
anagaaagcgagtttctttcaacttcactgaggcatcagttgctctttggcaatgtcccttaaccatgattattaactaagtttgtggcttgagtttacaaattctacttgttgcattgatgttcccatgtagtaagtcatttttagtttggttgtgaaaaaaccctgggctgaagttggcatttcagttaaaagaaaaaaagaaactagtcccagatttgaaaacttgtaataaaattgaaactcactggttttctatgtctttttgaactcttgtaatcgagttttgatcatattttctattaaagtggctaacacctggctactcttactgt

SEQ ID NO: 57416 - DNA, 476 bp, Homo sapiens
  misc_feature 17, 328: n = A,T,C or G
ctagatcattatctgcnaaaaaagtatccccagccaagacgacccatcagaccactctgcaacaatagagactaagatgctgcttaaaggccttgctgcatgttgaggaagagttgatgaaggagtctggatatccattctttttctatggtttgcctcccagtttcaagaggtctgaatgcagttgcagacgaagttttaactgtggctctgcctgtcattctaaacaagcaaaggctgccagaaataagacgaaaagacaaaatgctaaactatagctagagcagcaatgaataaataaataggtcaataaacacataagcaagcncatatagaaaataaacaaaatatttctcgaaaggagagggaaaacagacacatagaagaaaatgataataatagctgccatttactgagtgtatactacacattgtgaactttctcggacctcttcagtatattagatataggtaaat

SEQ ID NO: 57417 - DNA, 200 bp, Homo sapiens
  misc_feature 19: n = A,T,C or G
ggaacaaaataaatatttnagaaatagagctacacataaatggtcaattaatttttaatagaagtacaaaggcaattcaatgaagaaaggatagtcttttgaacaaatgatcctggaacaattgaatttccatatgcacagacatagattgatccgtataatgtgccatataaaaattaagcaagataaataattgacct

SEQ ID NO: 57418 - DNA, 480 bp, Homo sapiens
agagcaatgactgtgctcaccagtaaaagtaaacctttctttctgaaatagtcaaatacgaaattagaaaagccctccctattttaactacctcaactggtcagaaacacagattgtattctatgagtcccagaagatgaaaaaaattttatacgttgataaaacttataaatttcattgattaatctcctggaagattggtttaaaaagaaaagtgtaatgcaagaatttaaagaaatatttttaaagccacaattattttaatattggatatcaactgcttgtaaaggtgctcctcttttttcttgtcattgctggtcaagattactaatatttgggaaggctttaaagacgcatgttatggtgctaatgtactttcacttttaaactctagatcagaattgttgacttgcattcagaacataaatgcacaaaatctgtacatgtctcccatcagaaagattcattggcatgccccag

SEQ ID NO: 57419 - DNA, 478 bp, Homo sapiens
  misc_feature 12: n = A,T,C or G
gactgccaaagnaatcaaacgagaagcagtaacaatataatgtctattgataagaaagtagatcttaaatgttctcaccacacacaaaaatgataagtatatgaggtgaatagatatgttaattaccttggtttaatcattccacaatgtatatatataacaaaaaagtatattgtgtgctgtaaatatatacaatttttatttgtcaattatgcttaatgaagttgggagaacaatatatctacaaaatcctcaaatatgtgaaatgcaaatcaaacttctaatatatatataaatatatatgaatattgacaaatatatacaaatatatataaatgtttgatatatgtaaaatatgtattgaagaaaagtactataagaaaaattacaaaatattttgatggaatgataactgatacaaaataccaaaatttgtagaatgctgctaaaaagtatttagaaggaaatttatagtttt

SEQ ID NO: 57420 - DNA, 432 bp, Homo sapiens
  misc_feature 403: n = A,T,C or G
gattcttcccctctctacaaccctctctcctcagcgcttcttctttcttggtttgatcctgactgctgtcatggcgtgccctctggagaaggccctggatgtgatggtgtccaccttccacaagtactcgggcaaagagggtgacaagttcaagctcaacaagtcagaactaaaggagctgctgacccgggagctgcccagcttcttggggaaaaggacagatgaagctgctttccagaagctgatgagcaacttggacagcaacagggacaacgaggtggacttccaagagtactgtgtcttcctgtcctgcatcgccatgatgtgtaacgaattctttgaaggcttcccagataagcagcccaggaagaaatgaaaactcctctgatgtggttgggggggntgccagctggggccctccctgtcgccagt

SEQ ID NO: 57421 - DNA, 366 bp, Homo sapiens
  misc_feature 14, 15, 46, 147, 155, 214, 271, 326, 356, 361, 364: n = A,T,C or G
agtgacttctgacnnacagtatgtggggagaagggatgtgtattanccccggaggacgtgatgtgagacccgcttgtgagtcctccacactcgttccccattggcaagatacatggagagcaccctgaggacctttaaaaggcaaanccgcaagncagaaggaggctgggtccctgaatcaccgactggaggagagttacctacaagagccttnatccaggagcatccacactgcaatgatataggaatgaggtctgaactccactgaatnaaaccactggcttttgggggctgttcattatagcagtgcaaagagttcctttatnctccccaaggatggaaaatacaatttattntgctnccngt

SEQ ID NO: 57422 - DNA, 465 bp, Homo sapiens
  misc_feature 15: n = A,T,C or G
attatttcttccgantattgacaatgtgtgagactccagtaaccccggagctctcgtctgtaatcagcacatttatccacatttaagggggaaaatccgaattaaatccccgtgaccctgattgggttacagtgtcattttccctggatcctcttttaaatccactccacactgcttctctgtctattacatgctaatttaattttactgtggaagatattttcaggatttgctgaggacagtaaattttgtagtttatgttatttcactttttatgacttttaacacttaataaaattttattagagcacttttgtgtttacaaggccacaaaactcttggcaggttgtcaagaagtcctttttattatgatcctactgatatactgcgagtaatgaaataatcatgtccagaaatgtatcaaaggccagagggattatcccacttaatagctccacagatgcg

SEQ ID NO: 57423 - DNA, 197 bp, Homo sapiens
  misc_feature 197: n = A,T,C or G
aaaatggggttgagtgtgcagatctctgctcagcttcccttgcgtttaaggcctgccctagccagggctccctcctgcttccagtaccctctcatggcataggctgcaacccagcagagggcagctagatggacatttcccctgctcggaagggttggcctgcctggctggggaggtcagtaaactttgaatagtan

SEQ ID NO: 57424 - DNA, 466 bp, Homo sapiens
  misc_feature 20: n = A,T,C or G
ggatacggaagctgccctgngtgcttaagagaagcagcagaacgcggaaacgtctatgctcaagggaatctcgtggagtattactataagatgaaattttttacaaagtgtgttgcattttccaaaaggatcgctgactatgatgaggttcacgacatccccatgatcgcccaggtcacagactgtctcccggagttcatcggcagaggcatggcaatggcatccttctaccacgcaaggtgtcttcagcttggcttgggcatcaccagggatgaaacaaccgctaaacactattattctaaagcttgtcgtctgaatcccgcattggcagatgaacttcactccttacttattcgtcaaagaatttagaccacaatgtatttcaacaaagatcatcaatgctaacacctcacaatgtgtgtatttttacagtagctatgtttgggtatttttgcacatcacaaat

SEQ ID NO: 57425 - DNA, 486 bp, Homo sapiens
  misc_feature 30, 469, 474, 481: n = A,T,C or G
gacaactcggtggtggccactgcgcagatnttacttcgctcgtactcgtgcgcctcgcttcgcttttcctccgcaaccatgtctgacaaacccgatatggctgagatcgagaaattcgataagtcgaaactgaagaagacagagacgcaagagaaaaatccactaccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggcagggaaggaaagaacttgcatgttggtgaaggaagaagtggggtggaagaagtggggnggggncgacagngaaat

SEQ ID NO: 57426 - DNA, 448 bp, Homo sapiens
  misc_feature 319, 368: n = A,T,C or G
agtggaatacctggaaattctttcaatgtgtcatccctggttgagctggatctgtcctataacaagcttaaaaacataccaactgtcaatgaaaaccttgaaaactattacctggaggtcaatcaacttgagaagtttgacataaagagcttctgcaagatcctggggccattatcctactccaagatcaagcatttgcgtttggatggcaatcgcatctcagaaaccagtcttccaccggatatgtatgaatgtctacgtgttgctaacgaagtcactcttaattaatatctgtatcctggaacaatattttatgggntatgtttttctgtgtgtcagttttcatagtatccatattttattactgnttattacttccatgaattttaaaatctgagggaaatgttttgtaaacatttattttttttaaagaaaagatgaaaggcag

SEQ ID NO: 57427 - DNA, 467 bp, Homo sapiens
  misc_feature 8: n = A,T,C or G
gagcaganaagaaggagaaagcagcatcttgcctggatgagccaggggacacagaagagaagcccactatctcatttaatctttacaactctcttgcaaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtctggacaaagtgccaaaggatcttccccctgacacaactctgctagacctgcaaaacaacaaaataaccgaaatcaaagatggagactttaagaacctgaagaaccttcacgcattgattc

SEQ ID NO: 57428 - DNA, 447 bp, Homo sapiens
attatggccgggtacatggaaactgaacaactggctcctgaaagactactgggtacataacgaaatgaaggcagaaataaagatgttctttgaaaccaacgagaacaaagacataacataccagaatctctgggacacattcaaagcagtgtgtagagggaaatttatagcactaaatgcccacaagagaaagcaggaaagttctaaaattgacaccctaacatcacaatgaaaagaactagagaagcaagagcaaacacattcaaaagctatcagaaggcaagaaataactaagatcagagcagaactgaaggaaatagagacacaaaaaacccttcaaaaaatcaatgaatccaggagctggttttttgaaaagatcaacaaaattgatagaccgctagcaagactaataaagaagaaaagagagaagaatcaaatagacgcaat

SEQ ID NO: 57429 - DNA, 283 bp, Homo sapiens
  misc_feature 77: n = A,T,C or G
atctgtgcagaacatgatgcgtcgaaaggaacaagaacacatgataaattgggtggagaagcacgtggtgcaaagcntctccacacagcaggaaaaggagacaattgccaagtgcattgcggacctaaagctgctggcaaagaaggctcaagcacagccagttatgtaaatgtatctatcccaattgaggcagctagaaacagttgactgactaaatggaaactagtctatttgacaaagtctttctgtgttggtgtctactgaagttatagtttacccttcc

SEQ ID NO: 57430 - DNA, 342 bp, Homo sapiens
ctgtaaaccctgctactgggtttgaagagttttagtcatcctttaacaatttttaaaaatttagcttctggattccatttggtaaggaaatcaatattggaagtattgctaaaatcttataatatgaaaagagatccactaatgtagcttaaggttattagatttgggcttttaatcatggaataatcttatgtattggtgtaagagttgatgaatgactttagctgtgtgaatatataatagtcaaactgcaaacattttgcatcccttttgtgacctaatttacagacatttaaattgtgttgcagttctgctttgccgtttaataaaaagctatttccg

SEQ ID NO: 57431 - DNA, 445 bp, Homo sapiens
gaactacaaagacagacttggtccttttcaacggttttcacagatccggtgacccacgctctgaagacagaattagctaactttcaaaaacatctggaaaaatgaggacttgggtaaaaatcgtatttggagttgccacctctgctgtgcttgccttattggtgatgtgcattgtcttacgcccttcaagagttcataactctgaagaaaatacaatgagagcactcacactgaaggatattttaaatggaacattttcttataaaacatttttttccaaactggatttcaggacaagaatatcttcatcaatctgcagataacaatatagtactttataatattgaaacaggacaatcatataccattttgagtaatagaaccatgaaaagtgtgaatgcttcaaattacggcttatcacctgatcggcaatttgtatatctag

SEQ ID NO: 57432 - DNA, 476 bp, Homo sapiens
  misc_feature 103: n = A,T,C or G
gaaataaagatggagactttaagaacctgaagaaccttcacgcattgattcttgtcaacaataaaattagcaaagttagtcctggagcatttacacctttggngaagttggaacgactttatctgtccaagaatcagctgaaggaattgccagaaaaaatgcccaaaactcttcaggagctgcgtgcccatgagaatgagatcaccaaagtgcgaaaagttactttcaatggactgaaccagatgattgtcatagaactgggcaccaatccgctgaagagctcaggaattgaaaatggggctttccagggaatgaagaagctctcctacatccgcattgctgataccaatatcaccagcattcctcaaggtcttcctccttcccttacggaattacatcttgatggcaacaaaatcagcagagttgatgcagctagcctgaaaggactgaataatttggctaagttgggatttgag

SEQ ID NO: 57433 - DNA, 446 bp, Homo sapiens
cggaagcgttggaggacattccctgttgactgcgtcgcgatgtgtggcgactgtgtggagaaggaatatcccaaccggggtaatacctgcctggagaatggatctttcttactgaactttacaggctgtgcagtgtgcagtaagcgggattttatgctgatcacaaacaaatccttgaaagaagaagatggagaagaaatagttacctatgatcatttgtgtaagaattgtcatcatgtaatagccagacatgagtatacattcagtatcatggatgaatttcaggagtataccatgctgtgtctgttatgcggcaaagccgaagatactatcagtattctccctgatgacccccgacaaatgactctcttattctaaggatccttctacagatctgttataactatattggggtggggttacaatacagcaagcctgatggtttg

SEQ ID NO: 57434 - DNA, 429 bp, Homo sapiens
  misc_feature 24: n = A,T,C or G
gaggaagtggatgagctgtacagnagaagcacctattgacaaaaaggggaatttcaattacatcgagttcacacgcatcctgaaacatggagccaaagacaaagatgactgaaagaactttagctaaaatcttccagttacattgtcttactctcttttacttctcagacacttcccccaccctcatagaacctgttgcatgcaacttagtttcacagctttgcctcttctttttgatgtatttattccagacctttctgccacttagcacttgtataatcagactggaaatggggatgagggtgtaaattgtattgaaaaagatcgcgaataaaaatcaacaaatgtgaaagcccagaaaaatatattcgtatttctggttttgctggatttttacatttttatataataaaaatgttattttgaaac

SEQ ID NO: 57435 - DNA, 385 bp, Homo sapiens
gagtggatgtgttttgtgtctgagaaggacatgaattttgaggggccagatggcagaattttaggggttgaattgtatgctctccaaatgtatataagttaaagtcctaactcctagtacctagaatgtgaccatatttggagatggggcctttaaaaaggtaattaagataaaatgacgttatacatatgagccctaatccaatatgaatggtgtctttgtaagaggttaggacaaacacaaagggaagatcatgtgatgacactggagaaagaaggccatctacaaactgaggagggaggcctgagaagagataaaccctgtggacatcttaatcttggacatctagccttcagaagtgtgggaaaataaatttctattgttt

SEQ ID NO: 57436 - DNA, 412 bp, Homo sapiens
gagtcaggaaggacgttggtgttgaggttagcatacgtatcaaggacagtaactaccatggcttccgaagttttgccaaaacctcggatgcgtggccttctggccaggcgtctgcgaaatcatatggctgtagcattcgtgctatccctgggggttgcagctttgtataagtttcgtgtggctgatcaaagaaagaaggcatacgcagatttctacagaaactacgatgtcatgaaagattttgaggagatgaggaaggctggtatccttcagagtgtaaagtaatcttggaatataaagaatttcttcaggttgaattacctagaagtttgtcactgacttgtgttcctgaactatgacacatgaatatgtgggctaagaaatagttcctcttgataaataaacaattaac

SEQ ID NO: 57437 - DNA, 246 bp, Homo sapiens
gggggctttagttataactgggctaagcataattgcgctaccaattccatattatctcatggcacttaattttataattgatatatataataaaaaattcaatgcagatattgatataataaaaatagataatggtaatccaagcacgatggtagccatcactctaattgctttggggttaacctataacttattaagtaaagtgccagaatggttctttgacagtattaaaattaaagaaaacag

SEQ ID NO: 57438 - DNA, 487 bp, Homo sapiens
  misc_feature 4, 5: n = A,T,C or G
agannctgaaattctgcctcctgaactcaagagtggagaatactgggttgaccctaaccaaggatgcaaattggatgctatcaaggtattctgtaatatggaaactggggaaacatgcataagtgccaatcctttgaatgttccacggaaacactggtggacagattctagtgctgagaagaaacacgtttggtttggagagtccatggatggtggttttcagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgaaacacactggggaatggagc

SEQ ID NO: 57439 - DNA, 408 bp, Homo sapiens
  misc_feature 13: n = A,T,C or G
gcttttcacaagnatggcgccgaaagcgaataaggaagctcctgcccctcctaaagctgaagccaaagcgaaggctttaaaggccaagaaggcagtgttgaaaggtgtccacagccacaaaaagaagaagatccgcacgtcacccaccttccggcggccgaagacactgcgactccggagacagcccaaatatcctcggaagagcgctcccaggagaaacaagcttgaccactatgctatcatcaagtttccgctgaccactgagtctgccatgaagaagatagaagacaacaacacacttgtgttcattgtggatgttaaagccaacaagcaccagattaaacaggctgtgaagaagctgtatgacattgatgtggccaaggtcaacaccctgattcggcctgatga

SEQ ID NO: 57440 - DNA, 300 bp, Homo sapiens
  misc_feature 5, 162: n = A,T,C or G
acttntttggacccccggggaattcggtttttatgggccgggaatctaaattaaaaaagaaagaaatttgaaaaaactttctctttgccatttcttcttcttcctttttaactgaaagctgaatccttccatttcttctgcacatctacttgcttaaattgngggcaaaagagaaaaagaaggattgatcagagcattgtgcaatacagtttcattaactccttcccccgctcccccaaaaatttgaatttttttttcaacactcttacacctgttatggaaaatgtcaacctttgtaag

SEQ ID NO: 57441 - DNA, 472 bp, Homo sapiens
  misc_feature 208, 211, 213, 373: n = A,T,C or G
gacataaagtaaaggagaacagctatattgtcctttctataagcttgtcactgcaaaaagttgccttttgcttgtcaggtttggatagaatataattgattggtttgttacttggactaacaaggcagtagatttgcctgtgtggaattttttttcctatttttcttctttttgctttttttgcacttatcagaaatatttgatgtgngcntngttgaaaaatactggatacatgtcttgtcagaattgtcgtattaagtaatgtctttccctcttgcttctttggcaaatgttgatacacagtgtttggacttactgaagagttactgaagcctgtgggacttaataaatacaatatgctactccctgttgngattgaacaatacaaataacaaacaagaaagacaatgccttccattagtctgctattctgtttccttcaacttcatacatagattcatatatgaagtac

SEQ ID NO: 57442 - DNA, 466 bp, Homo sapiens
  misc_feature 70: n = A,T,C or G
gaagcaaataaattatttaaggagggcaaagaggtactggtagttaactctcaaggagaaatttcacggntgagcaccaaaaaggaagtgatcatgaaaggaaatatcaacaattattttaaattgggtcaagaagggaagtatcgcgtctaccacaatcaatactccaccaattcatttgctttgaataagcaccagcacagagaagaccatgataagagaaggcatcttgcacataagttctgtctgactccagcaggagagttcaaatggaacggttctgtccatgggtccaaagttcttaccatatctactctgagactgactatcacccaattagaaaacaacatcccttcatcctttcttcatcccaactgggcatcacatagggcaaattggatcaaggcagttcagatgtgtagcaaacccagagaatttgcattggctttagccattttggagtgtg

SEQ ID NO: 57443 - DNA, 344 bp, Homo sapiens
gcaactcggaaactataagtaattctcaagaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgcctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaatttcca

SEQ ID NO: 57444 - DNA, 454 bp, Homo sapiens
  misc_feature 190: n = A,T,C or G
ggctctttttccggctggaaccatggagggtgtagaagagaagaagaaggaggttcctgctgtgccagaaaacccttaagaaaaagcgaaggaatttcgcagagctgaagatcaagcgcctgagaaagaagtttgcccaaaagatgcttcgaaaggcaaggaggaagcttatctatgaaaaagcaaagcnctatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatgggggta

SEQ ID NO: 57445 - DNA, 473 bp, Homo sapiens
  misc_feature 18, 33: n = A,T,C or G
agcaaacatcatcatttnccccaaaattttgtnacagaaaaggcgtatcaaatgaaaaataatttcagagatctttctttcaagatattttttcctgataaaatacattgtcttgaagtaaatacattgtcaaaacctaattgcaattctgttaaatctaagtaatttttagacagtgtttcaccgtattatttaggatgtgaaatgccatttctttcactgattacaccatatacaggaaacaggtaaaacagtgaaaactttattgtgctggttgatgccaacttggttgaaaagctctctgcagaagaagtgatctagactgacagaagtgttgctaattacaagttgtgttctcatgacgtaattagaaagtaacttctcaaagtacaacttttatgaaaaaaataagctgttaaaaaaaggaaatcgtaggttaatttaattggggaaaatgggcaattgacagagac

SEQ ID NO: 57446 - DNA, 458 bp, Homo sapiens
  misc_feature 178, 179: n = A,T,C or G
atgtctcctaggattgtggatgagggctattttctctctgtcaaagaaaggaagagggctagaatgaagcctggttattagatttttatcttagatatcaagaaaaatatgtatcacagatatacaaataatgaaatgggagtatatgcgtgtgttcatttaaatattcccagctctnnctgctgagagggcctagaagcattaacaccccagtggtggtgagcacatttggtacctagttcttggtttctaaatatcattctctagcaaaagaaaccaagaatccttgtagaaatggatgattccagggccagaaccagaaacatgtcataaaagtctggaacatcttttggtcccagaaagtagggaaggagtaaacaatgatgaaaacattgaaataacgcaggatccaccctgaagtagctccctatttccaaattcgggacatttgagcaaga

SEQ ID NO: 57447 - DNA, 319 bp, Homo sapiens
tgcttttgcttttaaaaattgaagaagttttaaacagggctttcatttggtcatccttgcaatccattggggtctagtttggaatctgacaaccggaacaaaaagaaccttgaatccggtgcatgccttggttttggtgctgctgctgcttcccaagatcctcagcagggattaagaaggaacccggtgtgcacaagcagatccccgaaattggtgggcttgacctcctggcaaattgctgcgtctttccactagctgttcaggaccactaaatgctgaaatgtggatgcatacccgaaataaaagcaattcattgtgt

SEQ ID NO: 57448 - DNA, 297 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgt

SEQ ID NO: 57449 - DNA, 193 bp, Homo sapiens
  misc_feature 39, 96: n = A,T,C or G
cataaccaaaaaagaaaactaaagaccaatatccctggngaatatagatgctaaaatccttaataaaatactagctaaccaaatccaacaacgtancaaaaagataatccaccatgatcaagtgggtttcataccagggacgcaggaatggtttaacatacacaagtcaataaatgtgatacaccacataagc

SEQ ID NO: 57450 - DNA, 474 bp, Homo sapiens
  misc_feature 6: n = A,T,C or G
acaagnactcaaggaagatggaggctgtaccatatggtacaacgagatgcagttactatctgagatagaagaacacctgaactgtaccatttctcaggttgagccggatataaaggtaccagtggatgaatttgatgggaaagttacctacggtcagaaaagggctgctggtggtggaagctataaaggccatgtggatattttggcacctactgttcaagagttggctgcccttgaaaaggaggcgcagacatctttcctgcatcttggctaccttcctaaccagctgttcagaaccttctgatttttacatttactgaataagatttgagtaatgaaagtctgtagtcttaaaactctaaaacagttgtactgcttccaagcagcagtatttatagtaacgtaagctattaatgctaactcttgcatgtcaagaaacattagtcttaggaattcttcaaaaaatggcatccc

SEQ ID NO: 57451 - DNA, 256 bp, Homo sapiens
cattaaagctctgagatctaagaacacaattattattctaacaatgattattagctcattcacttattttgataactaatgatcacagctattatactactttctcgttattttgtgtgcatgcctcatttccctgacttaaacctcactgagagcgcaaaatgcagctttatactttttactttcaattgcctagcacaatagtgagtacatttgaattgaatatataataaatattgcaaaataaaatccatct

SEQ ID NO: 57452 - DNA, 195 bp, Homo sapiens
gaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacct

SEQ ID NO: 57453 - DNA, 271 bp, Homo sapiens
tcttaagtctaagggacttgctcctgatcttcctgaagatctctaccatttaattaagaaagcagttgctgttcgaaagcatcttgagaggaacagaaaggataaggatgctaaattccgtctgattctaatagagagccggattcaccgtttggctcgatattataagaccaagcgagtcctccctcccaattggaaatatgaatcatctacagcctctgccctggtcgcataaatttgtctgtgtactcaagtaataaaatgattgttt

SEQ ID NO: 57454 - DNA, 344 bp, Homo sapiens
  misc_feature 33: n = A,T,C or G
gaggaaactcaaggaaattcaaaataacacagnagaaggaattcagaattctatcagataaatttaacaatgatatggaaataattaaaaagaatcaagcagaaattctagagttaaaaatgcaattgacatactgaagaatgcatcagaacctcttaatagcagaactggtcaagcaaagaagtaattagtgagtatctctggacacacttgggacctgggggtacacgcagctctgaagggaagtgcacaaacatggctctgaagggaagcacacaaacctacttggcattaccagctatttgagaagacaggctatttgaaaatacatggtcagtggagat

SEQ ID NO: 57455 - DNA, 432 bp, Homo sapiens
ggtttaaactacctcaaaacactttcccatgagtgtgatccacattgttaggtgctgacctagacagagatgaactgaggtccttgttttgttttgttcataatacaaaggtgctaattaatagtatttcagatacttgaagaatgttgatggtgctagaagaatttgagaagaaatactcctgtattgagttgtatccgtgtggtgtattttttaaaaaatttgatttagcattcatattttccatcttattcccaattaaaagtatgcagattatttgcccaaagttgtcctcttcttcagattcagcatttgttctttgccagtctcattttcatcttcttccatgggtccacagaagctttgtttcttgggcaagcagaaaaattaaattgtacctattttgtatatgtgagatgtttaaataaattg

SEQ ID NO: 57456 - DNA, 465 bp, Homo sapiens
ggtccgacatcttgacgaggctgcggtgtctgctgctattctccgagcttcgcaatgccgcctaaggacgacaagaagaagaaggacgctggaaagtcggccaagaaagacaaagacccagtgaacaaatccgggggcaaggccaaaaagaagaagtggtccaaaggcaaagttcgggacaagctcaataacttagtcttgtttgacaaagctacctatgataaactctgtaaggaagttcccaactataaacttataaccccagctgtggtctctgagagactgaagattcgaggctccctggccagggcagccctttcaggagctccttagtaaaggacttatcaaactggtttcaaagcacagagctcaagtaatttacaccagaaataccaagggtggagatgctccagctgctggtgaagatgcatgaataggtccaaccagctgtacatttggaaaaat

SEQ ID NO: 57457 - DNA, 465 bp, Homo sapiens
  misc_feature 393, 444: n = A,T,C or G
gtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttatatacaatgcttctttcctgtatattctcttgnctggctgcacccctttttcccgcccccagattgataagtaatgaaagtgcnctgcagtgagggtcaaaggag

SEQ ID NO: 57458 - DNA, 434 bp, Homo sapiens
  misc_feature 377: n = A,T,C or G
aaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgnatgtgccaaagctttactactgtggaaagacaactgttttaataaaagatttacatt

SEQ ID NO: 57459 - DNA, 347 bp, Homo sapiens
gtaagacttaagtgagttaggtctttaaggaaagcaacgctcctctgaaatgcttgtcttttttctgttgccgaaatagctggtcctttttcgggagttagatgtatagagtgtttgtatgtaaacatttcttgtaggcatcaccatgaacaaagatatattttctatttatttattatatgtgcacttcaagaagtcactgtcagagaaataaagaattgtcttaaatgtcatgattggagatgtcctttgcattgcttggaaggggtgtacctagagccaaggaaattggctctggtttggaaaaattttgctgttattatagtaaacatacaaaggatgtcatc

SEQ ID NO: 57460 - DNA, 490 bp, Homo sapiens
  misc_feature 3, 31, 33: n = A,T,C or G
ganttcctgagctgacagcattcgggccgantngtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgcccgtgtgaaccatgtgactttgtcacagccccaagatagttaagtgggatcgagacatgtaagcagcatcatggaggtttgaagatgccgcatttggattggatgaattccaaattctgcttgcttgctttttaatattgatatgcttatacacttaca

SEQ ID NO: 57461 - DNA, 448 bp, Homo sapiens
gacgtttggtttggagagtccatggatggtggttttcagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaat

SEQ ID NO: 57462 - DNA, 451 bp, Homo sapiens
  misc_feature 13: n = A,T,C or G
agccttacaaagnatttctgcagtgatttgtgtgaagaagagaatgtttgtctttttcaatgaagctttgcagatcaccatgtggttgaaggttttagttgtggacacagtggtccctccttaatgatgaagatcactgccttgggcttcatggaaaacaggcccagcctggggctgcgtttggatttattgtttttattccacacttcctacttggtctctggaagttttaccacatgtaacagattcctttatatgtagtgaaaatcactatttgtagaaactgtcaggtcaaaatatttaactgactgttgacatgtattttcttttttccttgtttttgttttttggggttttctgctttaagatatataccactatgtatatccagttaactgagagaattttgactctcttaataaaactgcattaagttttttgattttggaag

SEQ ID NO: 57463 - DNA, 434 bp, Homo sapiens
atcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttg

SEQ ID NO: 57464 - DNA, 439 bp, Homo sapiens
  misc_feature 214, 390, 392, 421: n = A,T,C or G
atgagaatttgcaacaggggaggaaaaaagaaccaaaacttccaaggccctgctttttttcttaaaagtactttaaaaaggaaatttgtttgtattttttatttacattttatatttttgtacatattgttagggtcagccatttttaatgatctcggatgaccaaaccagccttcggagcgttctctgtcctacttctgactttacttgtggngtgaccatgttcattataatctcaaaggagaaaaaaaaccttgtaaaaaaagcaaaaatgacaacagaaaaacaatcttattccgagcattccagtaacttttttgtgtatgtacttagctgtactataagtagttggtttgtatgagatggttaaaaaggccaaagataaaaggntnctttttttttccttttttggctatgaagntgctggttattttttttt

SEQ ID NO: 57465 - DNA, 497 bp, Homo sapiens
  misc_feature 13, 14: n = A,T,C or G
atacaaaacgacnnttgcatcccaggaaggggttcccagaagtcagaatccaagatggatgggaagcacaaaatgcaagaggaaaatgttaaactaaaaaagcccctggaagaaagccacaggctgcaaccccaccctatggatgaacaggatcagctgctgctctctgaaaagccacagttgtgtcagctatgccaggaagacggcagcctaacaaagaatgtgtgtaagaactgcagcggaaccttctgtgatgcctgttcaacaaatgaactgcctcttccttcaagtatcaagcttgagcgagtttgcaatccctgtcacaagcatctgatgaagcaatattccaccagcccatcataagactggaggccaagacctggaccaaaacgtttatgcaggctcctctgtacctgtgttttagctgtcaggatctcatagagcccagttcttagagtcaactaaagagttgataggaatttactaggtccagggag

SEQ ID NO: 57466 - DNA, 203 bp, Homo sapiens
gtgacagccactgaccggatgagggtgtcaatgcggagatcacctactctttcaaatccctacgagatgatattggaaatatgtttgtgctagaccatcaaaatggggaaattaaatccaaagacttaatagacttcgaatttcgtagcagttataccatgagagtagaagctaaggatggtggaggcatgaccagcgaatgt

SEQ ID NO: 57467 - DNA, 346 bp, Homo sapiens
ggaatcggtggtgctgaccaggaattctttgtggacattggcccagtctgtttcaaataaatgaactcaatctaaattaaaaaagaaagaaatttgaaaaaactttctctttgccatttcttcttcttcttttttaactgaaagctgaatccttccatttcttctgcacatctacttgcttaaattgtgggcaaaagagaaaaagaaggattgatcagagcattgtgcaatacagtttcattaactccttcccccgctcccccaaaaatttgaatttttttttcaacactcttacacctgttatggaaaatgtcaaccctttgtaagaaaaccaaaataaaaattg

SEQ ID NO: 57468 - DNA, 465 bp, Homo sapiens
cattgctaagacaccttttactgaggttcttaccagctcagccaaatctccactctgctatagcagaagcaataatgtttgctttaaaaagatttcttgacctatgccttttcttagaaagtttgatagattagttagaacttcagatcatcagatcagtctcaaatgggtttcttggaattttatatttgacaatatttatactataccaaactcatttgcagttcttaggtttgttggttaaaacatttttttaaagcagtaagtttatagaaaatgttttcatttaatggaaggctggggaatgtccagcatcaacccctatggcatgcattcccagtggccttctcatctgggcctggaacctttggttcagggcttaggggagaacaggccacatggcaacagccccacagtcattgccttcaacacagagccacgtgtccccaaacagcaatagtcatg

SEQ ID NO: 57469 - DNA, 466 bp, Homo sapiens
ctggttcagtgcattcagaacaagcccctgtattttgctgatcggctgtatgactccatgaagggcaagggggcgcgagataaggtcctgatcagaatcatggtctcccgcagtgaagtggacatgttgaaaattaggtctgaattcaagagaaagtacggcaagtccctgtactattatatccagcaagacactaagggcgactaccagaaagcgctgctgtacctgtgtggtggagatgactgaagcccgacacggcctgagcgtccagaaatggtgctcaccatgcttccagctaacaggtctagaaaaccagcttgcgaataacagtccccgtggccatcccggtgagggtgacgttagcattacccccaacctcattttagttgcctaagcattgcctggccttcctgtctagtctctcctgtaagccaaagaaatgaacattccaaggagttggaagtga

SEQ ID NO: 57470 - DNA, 470 bp, Homo sapiens
  misc_feature 211: n = A,T,C or G
gctggaaggcgaggagagcaggatttctctgcctcttccaaacttttcctccctgaacctgagggaaactaatctggattcactccctctggttgatacccactcaaaaaggacacttctgattaagacggttgaaactagagatggacaggttatcaacgaaacttctcagcatcacgatgaccttgaataaaaattgcacacactcagngcagcaatatattaccagcaagaataaaaaagaaatccatatcttaaagaaacagctttcaagtgcctttctgcagtttttcaggagcgcaagatagatttggaataggaataagctctagttcttaacaaccgacactcctacaagatttagaaaaaagtttacaacataatctagtttacagaaaaatcttgtgctagaatactttttaaaaggtattttgaataccattaaaactgcttttttttttccagcaagt

SEQ ID NO: 57471 - DNA, 293 bp, Homo sapiens
  misc_feature 2, 45, 66, 218, 240, 244, 263: n = A,T,C or G
gnggccgggcaatactgtagggaacaagcatgatcttgttactgngatattttaaatatccacagnactcactttttccaaatgatcctagtaattgcctagaaatatctttctcttacctgttatttatcaatttttcccagtatttttatacggaaaaaattgtattgaaaacacttagtatgcagttgataagaggaatttggtataattatggngggggattattttttatactgnatgngccaaagctttactactgnggaaagacaactgttttaataaaagattta

SEQ ID NO: 57472 - DNA, 476 bp, Homo sapiens
gattcctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattgatatgct

SEQ ID NO: 57473 - DNA, 456 bp, Homo sapiens
  misc_feature 21: n = A,T,C or G
gaaactatgaagtttaaaagnagtcagagattagttttcctgtagaagaaatagtatgtctctctaaacagaagagaaattactggaaattctctctcctgtcagttaccctaaaaaccagctccagcaaagccatttcacgaacaattatgcatctataatgatctaaataataattggagaaaaatagtattttatggacattaaaatctcaattaatactattgcaactattgaatcaaatataaattgaattaaatttttaaattcaacagaaaatagcaaattggttactagaatattttgtctctaccaatttcactattacttctgaggtgtaaaccaaatataatactggcataaagaaggaaaaatatctcaagatttctaggcattttcctatgtctaatagtaggatgtcctctctgaatttatttattacaaaaataacattac

SEQ ID NO: 57474 - DNA, 288 bp, Homo sapiens
  misc_feature 8, 30, 31, 148, 213: n = A,T,C or G
gaagtccnagtggagagagcgagctgagtnnttgtgtggtcgcgtctcggaaaccggtagcgcttgcagcatggctgaccaactgactgaagagcagattgcagaattcaaagaagctttttcactatttgacaaagatggtgatggnactataacaacaaaggaattgggaactgtaatgagatctcttgggcagaatcccacagaagcagngttacaggacatgattaatgaagtagatgctgatggtaatggcacaattgacttccctgaatttctgacaatgat

SEQ ID NO: 57475 - DNA, 150 bp, Homo sapiens
cctgcagctaaacgatgaagaagcccaactggagtgttgctttgaagatgacgccttcttatattttcatagcaaatgggtggtatcaaaatcagacattgcttcttgctgataaaaagcctgaaggaaataagtgaaactacatctatg

SEQ ID NO: 57476 - DNA, 473 bp, Homo sapiens
agaaataataggtaaaaatcgtcttgcctactcattccaaagatgatcaagtcattaatctagcaaagtattcatgtatcagattttgtatattttgaatcaaagctaactaggaatgttagatataagaatgtaatgatattcatgcactgaattctaagccaatatgaacaaaaatgctgcatgaatggcacatataggtcaccaaagttcattcacaggtagaaaaaacttgtgctttcttttccatctaaaaacaaaaggagactttctttatctcatttaaagaacagctctttgaaattgaaattgaccctttttgcttgaccttaaggagattagcttccagtagatgagtttgcaaaatacttttcctgttcttttgttttgctggtattgaaaacatcccactaaatcagatgaagaggcatgggaggaaaaatatccaaattaattactaaaatcgagaagag

SEQ ID NO: 57477 - DNA, 431 bp, Homo sapiens
gctttcttttcagtccttgcgcaccggggaacaaggtcgtgaaaaaaaaggtcttggtgaggtgccgccatttcatctgtcctcattctctgcgcctttcgcagagcttccagcagcggtatgttgggccagagcatccggaggttcacaacctccgtggtccgtaggagccactatgaggagggccctgggaagaatttgccattttcagtggaaaacaagtggtcgttactagctaagatgtgtttgtactttggatctgcatttgctacacccttccttgtagtaagacaccaactgcttaaaacataaggatgtttcaggttcctccatttaacagatatgaagagcattttaagaggtgcagcctctggaagtggatcaaactagaactcatatgccatactagatatgtttgtcaataaacttat

SEQ ID NO: 57478 - DNA, 372 bp, Homo sapiens
attgttcagaaactgtcgaccgagttagaacggagccctcggtgatgcggacatctcagggaaacttgcgtactcagcacagcagtggagagtgttcctgttgaatcttgcacatatttgaatgtgtaagcattgtatacattgatcaagttcgggggaataaagacagaccacacctaaaactgcctttctgcttctcttaaaggagaagtagctgtgaacattgtctggataccagatatttgaatcttccttactattggtaataaaccttgatggcattgggcaaacagtagacttatagtagggttggggtagcccatgttatgtgactatctttatgagaattttaaagtggttctggatatcttt

SEQ ID NO: 57479 - DNA, 244 bp, Homo sapiens
caccctctaaatcaccacgatcaaaagggacaagcatcaagcacgcagcaatgcagctcaaaacgcttagcctagccacacccccacgggaaacagcagtgattaacctttagcaataaacgaaagtttaactaagctatactaaccccagggttggtcaatttcgtgccagccaccgcggtcacacgattaacccaagtcaatagaagccggcgtaaagagtgttttagatcacccccccccc

SEQ ID NO: 57480 - DNA, 239 bp, Homo sapiens
gaagaagcagtggatttgtaaaaatttttagtttataaattacagtcattggggaaacgctagtaaggtcatgtgatcttttggaccaggattttctctctgtcttctctctgggtgtgtgtgtgtgtatgtacagaagggctaccaggaagtgtcaaccatgttagattttctgtagtcttccagaaacagtgcagcccatacaacaggaatcttaattttcctcatctctaaaaaga

SEQ ID NO: 57481 - DNA, 254 bp, Homo sapiens
gattctatgaactcactttcaagaagagagagacgttgtctatccacaggttttctgcagtcctaattaaaaagaactgcagtgagaagtttttcatttcaacttccaacccaagcttgagggcatagcagtaactacagagtatattgtgttcattttgctgtttgagtagttcaggaaaaaggagttgcctttcaaacaccaaacaactaatatgattccctgcggacactgctatcacatcaagatttctt

SEQ ID NO: 57482 - DNA, 267 bp, Homo sapiens
cgagtgctagggggagggattacaatgagtggcaacgtctcacctgagttctccaggtacaggcctgatggcttttgcgcatgcctttgagcgagccccctggctcaaagtgtttttggcctgaagtattctaaatgcctaaaatttcatcatcgtaattttaataactgttggccgggcgtggtggcccacgcctgtaatcctagtactttgggaggccaaaggagagtcacttgagctcaggagtttgggactagcgtctctttt

SEQ ID NO: 57483 - DNA, 182 bp, Homo sapiens
ggcatggaaggagggtgagttctccgaggcccgtgaggatatggctgccctggagaaggattatgaggaggtgggcatcgactcctatgaggacgaggatgagggagaagaataaagcagctgcctggagcctattcactatgtttattgcaaaatcctttcgaaataaacagtttccttgc

SEQ ID NO: 57484 - DNA, 399 bp, Homo sapiens
attctggaatattgttaaacaactttttgcttttgaaaaaaaaaggtgccttgattcagttgcgtgacttagaacattcatcctattttattgtgatttttaatgtcttctgaccccaaactgtgtttttggttgcagtctggcggctgaggcatagcgtcggttttgttccaataacagagaccaaagagttaatcagatatggttcagctgctacaattgtatgattcaaaggcaatttaatcaccccaaatttccatggcccccacagtcaagacctgccattcgttttctcttgcaggttggagtaaatttgcactttgaatcatgtgggtcatttggggaccttgttcttttctattttgctttattaataaaggaacttgtggaaaaaaaatt

SEQ ID NO: 57485 - DNA, 245 bp, Homo sapiens
  misc_feature 12: n = A,T,C or G
cagatacacagnatttcacctgggagaacctctttttctccctcgactcttcctacgtaaactcccacccctgacttaccctggaggaggggtgaccgccacctgatgggattgcacggtttgggtattcttaatgaccaggcaaatgccttaagtaaacaaacaagaaatgtcttaattatacaccccacgtaaatacgggtttcttacattagaggatgtatttatataattatttgttaaat

SEQ ID NO: 57486 - DNA, 211 bp, Homo sapiens
attccctattcaataaatggtgctgggacaacgggctagccatatgcagaaaactgaaactggaccccttccttacaccatatacaaaaataaactcaaggtagattaaagaattcaatataaaaaccaaaactctaaaaatcctggaagaaaatctgggcaataccattcaggacataggcacaggcaaagatttcatgacaaaaatgac

SEQ ID NO: 57487 - DNA, 174 bp, Homo sapiens
cagctaggaataatggaataggaccgcggttctattttgttggttttcggaactgaggccatgattaagagggacggccgggggcattcgtattgcgccgctagaggtgaaattcttggaccgacgcaagacggaccagagcgaaagcatttgccaagaatgttttcattaatc

SEQ ID NO: 57488 - DNA, 474 bp, Homo sapiens
gtcatttgtaaagaagctccttccagcacctcctctcttctccttttgcccaaactcacccagtgagtgtgagcatttaagaagcatcctctgccaagaccaaaaggaaagaagaaaaagggccaaaagccaaaatgaaactgatggtacttgttttcaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgcccaaaagacgttttctttggaccaaagatctctttcgtgattccttgcaacaatcaatgagaatcttcatgtattctggagaacaccattcctgatttcccac

SEQ ID NO: 57489 - DNA, 473 bp, Homo sapiens
  misc_feature 471: n = A,T,C or G
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaggacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggnga

SEQ ID NO: 57490 - DNA, 476 bp, Homo sapiens
ggcgagctatttccttataccacgtttggaggagtcatggtctttgtgtttggcattacttttcctttgctgttgatgtttatccatgcatcgttgagacttcggaacctcaagaacaaactggagaataaaatggaaggaataggtttgaagaggacaccgatgggcattgtcctggatgccctagaacagcaggaagaaggcatcaacagactcactgactatatcagcaaagtgaaggaataaacataacttacctgagctagggttgcagcagaaattgagttgcagcttgcccttgtccagacctatgttctgcttgcgtttttgaaacaggaggtgcaccgtaccacccaattatctatggcagcatgcatgtataggccgaactattatcagctctgatgtttcagagagaagacctcagaaaccgaaagaaaaccaccaccctcctattgtgtctgaagtttcacgtg

SEQ ID NO: 57491 - DNA, 465 bp, Homo sapiens
aataaataaataaagcaagcaagcaagctgaagatctggctgctaaagttgaaaacatactacaaagcagtagtaagcaaaatggcacagtactggcattaaaacagacacatagaccaacgaaatggaatagagaatacagaaatagattcacatatttacagtgaattaacttttaacaaatgttcaagaacactcagtggggaaaggacactctcttcaataaatgctgctgggaaaattggatatccatatgcgaaataacaagactagaccttcacctctcaccctatacaaatacaataaatataaaatcaattaaaatgtataaaaaacctaaatgcaagatgtaaactaacactactagaggaaacatagagaaaacacttcaggacatttgtctgggaaaagattttatgaataagacctcacaaacataggcaacaaaagcaaaaataaacaaat

SEQ ID NO: 57492 - DNA, 270 bp, Homo sapiens
cgcagtggctcacgcctggaatcccagcactttgggaggccgaggtgggtggatcatgaggtcaggagatcgagaccatcctggccaacatggtgaaaccccgtctctactaaaaatacaaaaattagctgggcatggtggcatgcacctatagtcccagctactcaggaggctgaggcaggagaattgcttgaacccagaaggcggaggtgtgcccgagatcgcgccactgcactccagcctggtgacagagcgagactccatctccga

SEQ ID NO: 57493 - DNA, 474 bp, Homo sapiens
atatacagaaaagcaggattactttacacacaatattccagtcattgctgtttttcaccaacaagctatcattcacatctttttcatactatatataaatttacatcctttattttagtggtgtatattgtgtggttgtgtcataaattatgtacctgttctctgttgaacatatagatttttttctgagtttttccttagcaaaatgctgcagtgagtacccttgtacatagatgtttgtacatttgttctagaaaaatctacagtaaagattcttagattaagagattcccaggttattagaaaatttctctattaatttagatatatacttccaaattgcctgaccaaaaagttatgtcaatttaacttctatgaacagtatgcaaacatgacaattttccatcacctacaccaactctgggtaatttcatcttttttacaagttgatggattgttttaatttatatttct

SEQ ID NO: 57494 - DNA, 321 bp, Homo sapiens
atcaattctctatcatgttgaagtaaatttggattttccaccaaattctgaatttgtagacatacttgtacgctcacttgccccagatgcctcctctgtcctcattcttctctcccacacaagcagtctttttctacagccagtaaggcagctctgtcgtggtagcagatggtcccattattctagggtcttactctttgtatgatgaaaagaatgtgttatgaatcggtgctgtcagccctgctgtcagaccttcttccacagcaaatgagatgtatgcccaaagacggtagaattaaagaagagtaaaatggctgttgt

SEQ ID NO: 57495 - DNA, 377 bp, Homo sapiens
  misc_feature 349, 377: n = A,T,C or G
atggcagaaaaccgacatgggggaaatcgccagcttcgataaggccaagctgaagaaaacggagacgcaggagaagaacaccctgccgaccaaagagaccattgagcaggagaagcggagtgaaatttcctaagatcctggaggatttcctacccccgtcctcttcgagaccccagtcgtgatgtggaggaagagccacctgcaagatggacacgagccacaagctgcactgtgaacctgggcactccgcgccgatgccaccggcctgtgggtctctgaagggacccccccccaatcggactgccaaattctccggtttgccccgggatattatagaaaattatttgtntgaataatgaaaataaaacacacctcgn

SEQ ID NO: 57496 - DNA, 480 bp, Homo sapiens
aatgcagtgccttgtcaagcagtaaacaccatccctaaaagcatctaggcagaggctggataggtaagccatgtcttggaaagagttaatagtctaattgcagagatcaagtaaggtatcctgggggaactcgtattaaatggaagagtagaattttagtaggtgtaaaaggaggggtctgtggaaatggaagagaatagttagaaaatagaaatggctagatgaccccaaaaacatccacctaactaggattttctgatatcaaagcttaatgattggtgtctcttaaagaaaaaagattatattttcaatcctagcatgaatttatcataccctagtaagtcatttctgccgtttgcctctgtctcatctgattatgggactattttattaaaatttgctataaaatagtattcttacaaaaaaactagctgggtgtggtggtgtgtgcctgtaatcccagctacttgggaggctgag

SEQ ID NO: 57497 - DNA, 465 bp, Homo sapiens
agtgtgcctgatgtcacctcatgatttgctgttacttttttaactcctgcgccaaggacagtgggttctgtgtccacctttgtgctttgcgaggccgagcccaggcatctgctcgcctgccacggctgaccagagaaggtgcttcaggagctctgccttagacgacgtgttacagtatgaacacacagcagaggcaccctcgtatgttttgaaagttgccttctgaaagggcacagttttaaggaaaagaaaaagaatgtaaaactatactgacccgttttcagttttaaagggtcgtgagaaactggctggtccaatgggatttacagcaacattttccattgctgaagtgaggtagcagctctcttctgtcagctgaatgttaaggatggggaaaaagaatgcctttaagtttgctcttaatcgtatggaagcttgagctatgtgttggaagtgccctggttt

SEQ ID NO: 57498 - DNA, 476 bp, Homo sapiens
attcctctatttgttcagatctcatagatgacccccaggtattgtcttttgacatccagcagtccaaggtattgaggcatattactggaagtaagaaatattactataattgagaactacagcttttaagattgtacttttatcttaaaagggtggtagttttccctaaaatacttattatgtaagggtcattagacaaatgtcttgaagtagacatggaatttatgaatggttctttatcatttctcttccccctttttggcatcctggcttgcctccagttttaggtcctttagtttgcttctgtaagcaacgggaacacctgctgagggggctctttccctcatgtatacttcaagtaagatcaagaatcttttgtgaaattatagaaatttactatgtaaatgcttgatggaattttttcctgctagtgtagcttctgaaaggtgctttctccatttatttaaaactaccca

SEQ ID NO: 57499 - DNA, 482 bp, Homo sapiens
gcttttcgcctcttttgtctttccgtggagctgtcgccatgaaggtcgagctgtgcagttttagcgggtacaagatctaccccggacacgggaggcgctacgccaggaccgacgggaaggttttccagtttcttaatgcgaaatgcgagtcggctttcctttccaagaggaatcctcggcagataaactggactgtcctctacagaaggaagcacaaaaagggacagtcggaagaaattcaaaagaaaagaacccgccgagcagtcaaattccagagggccattactggtgcatctcttgctgatataatggccaagaggaatcagaaacctgaagttagaaaggctcaacgagaacaagctatcagggctgctaaggaagcaaaaaaggctaagcaagcatctaaaaagactgcaatggctgctgctaaggcacctacaaaggcagcacctaagcaaaagattgtgaagcctgtgaaagtt

SEQ ID NO: 57500 - DNA, 330 bp, Homo sapiens
attcgagggcggatcctctctggcgtggtgaccaagatgaagatgcagaggaccattgtcatccgccgagactatctgcactacatccgcaagtacaaccgcttcgagaaacgccacaagaacatgtctgtacacctgtccccctgcttcagggacgtccagatcggtgacatcgtcactgtgggcgagtgccggcctctgagcaagacagtgcgcttcaacgtgctcaaggtcaccaaggctgccggcaccaagaagcagttccagaagttctgaggctggacatcggcccgctccccacaatgaaataaagttattttctcattccct

SEQ ID NO: 57501 - DNA, 476 bp, Homo sapiens
  misc_feature 36: n = A,T,C or G
gtaagtccactgacttattttatgacaagaaatttnaacggaattttgccaaactattgatacataagggttgagagaaacaagcatctattgcagtttctttttgcgtacaaatgatcttacataaatctcatgcttgaccattcctttcttcataacaaaaaagtaagatattcggtatttaacactttgttatcaagcacattttaaaaagaactgtactgtaaatggaatgcttgacttagcaaaatttgtgctctttcatttgctgttagaaaaacagaattaacaaagacggtaatgtgaagagtgcattacactattcttattctttagtaacttgggtagtactgtaatatttttaatcatcttaaagtatgatttgatataatcttattgaaattaccttatcatgtcttagagcccgtctttatgtttaaaactaatttcttaaaataaagccttcagtaaatgtt

SEQ ID NO: 57502 - DNA, 482 bp, Homo sapiens
  misc_feature 14: n = A,T,C or G
ataagcaacctagnagaaaacttttatctgccttgttttggctttcctggcatacttccttacttcatctccattttataattaagttttgggtcacaagtctaaggcaaaggagcttccatactgaaaatctacatttttaatgcttattttatcataaaaataatttgggtaattttctgcaagtgacttctaacttaacagtagaagtttaaaactgttcaaagaccaaagcacaacatttatctagtgtttgatcctagtataaaagaatggcaataattatgtgaacaggaattacatgcccttagaatgtgcattttttaacctattaaatttgccaatcttgcaaactattgtttacttgtattgcataattagatactcatattaacatattgaattcagaaaaagttagcaagccaagatgacattctctgtagcactattttaaattataatgaatgatcacataaaactct

SEQ ID NO: 57503 - DNA, 181 bp, Homo sapiens
gcaggttgttaaataattgtattaataaaaatggcagcaataagaacaatagaaaagtcaataaaaaggaaaagctgaagagtaatgacaaggacatactaaaacaaatgaaaataattaaataaaatttatatatatatatatacacacatacacacacacacacacacacacacacaca

SEQ ID NO: 57504 - DNA, 260 bp, Homo sapiens
  misc_feature 106, 120, 121, 173, 175, 182, 212: n = A,T,C or G
ggcccctcatttacataaatattatactagcatttaccatctcacttctaggaatactagtatatcgctcacacctcatatcctccctactatgcctagaaggaanaatactatcgctgnncattatagctactctcataaccctcaacacccactccctcttagccaatatngngcctatngccatactagtctttgccgcctgcgaagcngcggagggcctagccctactagtctcaatctccaacacatatggccta

SEQ ID NO: 57505 - DNA, 458 bp, Homo sapiens
  misc_feature 1, 2: n = A,T,C or G
nnttcttgagttcctgaattttgaacaggattacctggagcctggagccactttaagttgtacttctgactaaactggaattatgagtgaggaagagtgtttactaaataaatgactggggcaagcaaaattgaggaggaaattagaaactgtttgacaaactttaagagctacttgaaataacagaagtcttgattaatatgcaaataatggctagaaagtatggtttaactggaccctattatgccttttaaaaataatttcagtaacccataaatacatgttgtaaaaaattcaaatatacagaatggaataaaaaaatgatctccctttattaccctcccaaaggttaccagcgtttgaatttaataatgtatattctttcatgcttttttctgtgcacttacctaagtgtgaatatgtaaagggtttgttttgtatacaaatggggttatact

SEQ ID NO: 57506 - DNA, 229 bp, Homo sapiens
gtgggttgagtgagatgttggatattgctatcaatcgcagtagtctttcccctgtgtgaggctgaagcctcagattccttctaaacacagctatctagagagccacatcctgttgactgaaagtggcatgcaagataaatttatttgctgttccttgtctactgcttttttttccccttgtgtgctgtcaagttttggtatcagaaataaacattgaaattgcaaagtg

SEQ ID NO: 57507 - DNA, 460 bp, Homo sapiens
aattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtct

SEQ ID NO: 57508 - DNA, 477 bp, Homo sapiens
gggcattcctgaagctgacagcattcgggccgagatgtctcgctccgtggcctcagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattgatatg

SEQ ID NO: 57509 - DNA, 345 bp, Homo sapiens
agaatgacaaaagctcatcccacatggaaaaatcaaagcattcattacagagagaattttgaaataaatgcctatataaaaaatatatatgcctatataatgcctatgtatatgcctataaaatatatatataaaatgggggttataaacaatgaaggaaatagtgatactatctatgtgggaacaatactagtatccttcctttggatgaatacagtagctacagatgcaattctggggactctgtttagcaatagcttaactattgcttggctacaagcatggataacttgttcaaagataatgaggagttgtaaatatttaaataaacaggatttgcaccct

SEQ ID NO: 57510 - DNA, 472 bp, Homo sapiens
atggccggggaaactactaattttacatcatttccagtagaactgcaaaggtacagtactggtttagctttatggttaaaagcattggctctagagccagataacacaggctcaaaccctagttctgccgtttactggttgtgttaccttgggtaggttacttgacctttttgagcttcagatttctaatctttatttaatgagttttaataatagaataataggattgctttgaggatcaaataagttaataaaccacttagaacagtgttcaataggctggatttttgtttgtttgtttgtttgttgctattctttttgtgttatgttttgtatccagcagaagtggttatttagcttcctattttatgaggtaggactgatgggaattgacagtcttaggaaaaagtacaactgtaagtcagtggaagtttttcctagtcaagatgtcaaatgccagaggtcggattca

SEQ ID NO: 57511 - DNA, 464 bp, Homo sapiens
atgagttgtggagaggagagtctcagcagctctcctcccagtgatcaagagtgcaccttctttttcaacttcaaagtggcacaaacactgtgctttccatcttagaaatctgattgttctgtcagaatttatatttacaggtttcaaagcaataaatgggggaataggtagtttcctggtttagcccccatctagtcaggaattaatatactggaatacctaccttctatttgttattcagatcagatctggcctattttcatatttatcctaagccatcaaatggggtagtgcctcttaaaccattaacagtactttagacattggcactttatttttctcgtagatctttagctactttggggaggagggaaggtgctgataccttcaatttgttacttttcaagatttttaaaaataactagtgtagcttatcttaaacattttataaaaccttcagatgt

SEQ ID NO: 57512 - DNA, 377 bp, Homo sapiens
gggattggctgtgtgcaatactcctcacgagaggctaagaatattgtacacaaaagattcttgatgttcttgaggaaatccctaaaaatgcagcatatagaaagtatacagaacagattacaaatgagaagctggctatggttaaagcggaaccagatgttaaaaaattagaagaccaacttcaaggcggtcaattagaagaggtgattcttcaggctgaacatgaactaaatctggcaagaaaaatgagggaatggaaactatgggagccattagtggaagagcctcctgccgatcagtggaaatggccaatataattattaagtgactttggtgtgttcatgggaaactgatgtaattaaatattctgttttttt

SEQ ID NO: 57513 - DNA, 475 bp, Homo sapiens
  misc_feature 382: n = A,T,C or G
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggngacttaaacagcttaaagtttagtttaaaagttgtaggtgattaaaataatttgaaggcgatcttttaaaaagagattaaaccgaaggggatt

SEQ ID NO: 57514 - DNA, 363 bp, Homo sapiens
  misc_feature 13, 17, 207, 209: n = A,T,C or G
ctctccaagcagnaagnaagaagaagacaaagtaagccgaaggagccacagcccggaacagccacagccaagtacaagtgcaaattaactgccgtggtcaagtgtgtcagtgactgcacattggtttctgttctctggctatttgcaaaacctctcccacccttgtgtttcactccaccaccaaccccaggtaaaaaagtcttcctntnttccactcacacccatagcgggagagacctcatgcagatttgcattgttttggagtaagaattcaatgcagcagcttaatttttctgtattgcagtgtttataggcttcttgtgtgttaaacttgatttcataaattaaaaacaatggtcagga

SEQ ID NO: 57515 - DNA, 369 bp, Homo sapiens
agtttttgtagttcccaaacagttgctcaatttagagcaattaatttaacacctgccaaaaaaaggctgctgttggcttatcagttgtctttaaattcaaatgctcatgtgacttttatcacatcaaaaaatatttcattaatgattcacctttagctctgaaaattaccgcgtttagtaattatagtgggcttataaaaacatgcaactctttttgatagttatttgagaattttggtgaaaaatatttagctgagggcagtatagaacttataaaccaatatattgatatttttaaaacatttttacatataagtaaactgccatctttgagcataactacatttaaaaataaagctgcatattttt

SEQ ID NO: 57516 - DNA, 210 bp, Homo sapiens
  misc_feature 4: n = A,T,C or G
aagnaagcgtaagatttatacaccaaaaactgcaaaacattgtggaaagaagttaaaaagaacctgaataaatgaaaaaacattctgtattcatggattggaagacttaataatggtaaaatggcaatactccccaaattgacttatgcattcaatgcagtctctttaaaatcctagctgaaattcttacaaaaatggcaagatgattct

SEQ ID NO: 57517 - DNA, 129 bp, Homo sapiens
  misc_feature 21, 126: n = A,T,C or G
gaaagagctggagatcaaagnagatgatggctagacacaaacaggaacttacggaaaaagatgctacaattgcttctcttgaggaaactaataggacactaactagtgatgttgccaatcttgccnatg

SEQ ID NO: 57518 - DNA, 173 bp, Homo sapiens
ggcaacagaagtgagactcagtctaaaaaacaacaacaacaacaaaaacctatatggtattggcagaggggtagatgcataaatcagtggaagagaacagagaacccagaaatagacccatacaaaatatgtccaattgacatatttggcagaggcacaaaagcaattcagtg

SEQ ID NO: 57519 - DNA, 490 bp, Homo sapiens
gtatataattgaagtaattcctgataccccagcagaagctggtggtctcaaggaaaacgacgtcataatcagcatcaatggacagtccgtggtctccgccaatgatgtcagcgacgtcattaaaagggaaagcaccctgaacatggtggtccgcaggggtaatgaagatatcatgatcacagtgattcccgaagaaattgacccataggcagaggcatgagctggacttcatgtttccctcaaagactctcccgtggatgacggatgaggactctgggctgctggaataggacactcaagacttttgactgccattttgtttgttcagtggagactccctggccaacagaatccttcttgatagtttgcaggcaaaacaaatgtaatgttgcagatccgcaggcagaagctctgcccttctgtatcctatgtatgcagtgtgctttttcttgccagcttgggccattcttgcttagacagtcagcatttg

SEQ ID NO: 57520 - DNA, 458 bp, Homo sapiens
gaaatcatcatattgcataaaaccttaaagttctgttggtatcacagaagacaaggcagagtttaaagtgaggaattttatatttaaagaactttttggttggataaaaacataatttgagcatccagttttagtatttcactacatctcagttggtgggtgttaagctagaatgggctgtgtgataggaaacaaatgccttacagatgtgcctaggtgttctgtttacctagtgtcttactctgttttctggatctgaagactagtaataaactaggacactaactgggttccatgtgattgccctttcatatgatcttctaagttgatttttttcctcccaagtcttttttaaagaaagtatacctgtattttaccaaccccctctcttttcttttagctcctctgtggtgaattaaacgtacttgagttaaaatatttcgatttttttttttttt

SEQ ID NO: 57521 - DNA, 477 bp, Homo sapiens
gattcctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattgatatgctt

SEQ ID NO: 57522 - DNA, 474 bp, Homo sapiens
gggatggtcgtggcagacctgttccactccttgttggcagtcagcgcagaaccttgtgtattaaagattcagagcctttttgtgttagatgaaaacagctatccattacaacaagatttctccctcctggatttttatcctgacattgtaaagcatggggccaatgcccgtctctgaggccagaggaagaaattgcaggcatttcaaggaagaagtactgaaatgatttgtcttttgaaataaatgaatgacagggcttttgctttggattttttatgaaatatattttataaagagaattgcactagatatataaattaaaacttttttctaagaaaatcctgtgaggtttaaaaagattgtttttgtcttttggtttcttcctttctcctggagaaatgatctaccagtcaaggcaatatgtagcagatccctgggaattaaaggtttgcccatttgttcactgtatttagt

SEQ ID NO: 57523 - DNA, 478 bp, Homo sapiens
ggcttccgtttctggttttgctctagtgtttgggtttcttcgcggctgctcaagatgaaccgactcttcgggaaagcgaaacccaaggctccgccgcccagcctgactgactgcattggcacggtggacagtagagcagaatccattgacaagaagatttctcgattggatgctgagctagtgaagtataaggatcagatcaagaagatgagagagggtcctgcaaagaatatggtcaagcagaaagccttgcgagttttaaagcaaaagaggatgtatgagcagcagcgggacaatcttgcccaacagtcattcaacatggaacaagccaattataccatccagtctttgaaggacaccaagaccacggttgatgctatgaaactgggagtaaaggaaatgaagaaggcatacaagcaagtgaagatcgaccagattgaggatttacaagaccagctagaggatatgatggaagatg

SEQ ID NO: 57524 - DNA, 208 bp, Homo sapiens
  misc_feature 207, 208: n = A,T,C or G
atgtgacagccattgtgagactgatgcacaaactgtcacttggttaatttaagcacttctgttttcgtgaatttgcttgtttgtttcttcatgcctttacttactttgtcccatgctactgattggcacgtggcccccacaatggcacaataaagcccctttgtgaaactgttctttaaatgaaacacaagaaattggccactggtnn

SEQ ID NO: 57525 - DNA, 442 bp, Homo sapiens
  misc_feature 109, 412, 425: n = A,T,C or G
aattatgggaaatgcaaaagttgtttggatatggtagtgtgtggttctcttttggaatttttttcaggtgatttaataataatttaaaactactatagaaactgcagancaaaggaagtggcttaatgatcctgaagggatttcttctgatggtagcttttgtattatcaagtaagattctattttcagttgtgtgtaagcaagttttttttagtgtaggagaaatacttttccattgtttaactgcaaaacaagatgttaaggtatgcttcaaaaattttgtaaattgtttattttaaacttatctgtttgtaaattgtaactgattaagaattgtgatagttcagcttgaatgtctcttagagggtgggcttttgttgatgagggaggggaaacttttttttttctatanacttttttcaganaacatcttctgagtcat

SEQ ID NO: 57526 - DNA, 227 bp, Homo sapiens
  misc_feature 7: n = A,T,C or G
aaccaanttgtggaaccaaaaattaaagtgattgaaggcagtcttcagcctattatcaaaactgaaggacccacactaacaaaagtcaaaattgaaggtgaacctgaattcagactgattaaagaaggtgaaacaataactgaagtgatccatggagagccaattattaaaaaatacaccaaaatcattgatggagtgcctgtggaaataactgaaaaagagacacg

SEQ ID NO: 57527 - DNA, 107 bp, Homo sapiens
  misc_feature 22, 24: n = A,T,C or G
gctctgacagggtgctgcaagnanaacacagtagtaacctacccaaactggttatgaggcctgtgataaattctgaaggacaattaggttataagcaggtgaaaact

SEQ ID NO: 57528 - DNA, 471 bp, Homo sapiens
  misc_feature 393: n = A,T,C or G
agagtggattagcaagcaggagtacgacgagtcgggcccctccatcgtccaccgcaaatgcttctagacggactcagcagatgcgtagcatttgctgcatgggttaattgagaatagaaatttgcccctggcaaatgcacacacctcatgctagcctcacgaaactggaataagccttcgaaaagaaattgtccttgaagcttgtatttgatatcagcactggattgtagaacttgttgctgattttgaccttgtattcaagttaactgttccccttggtatttgtttaataccctgtacatatctttgagttcaacctttagtacgtgtggcttggtcactttcgtggctgaggtaagaacgtgcttgtggaagacaagtctgtggcttggngagtctgtgtggccagcagcctctgatctgtgcagggtattaacattgtcagggctgagtgttctgggatttctctag

SEQ ID NO: 57529 - DNA, 472 bp, Homo sapiens
  misc_feature 10: n = A,T,C or G
aacctagganattttctacctctttactaccctgctgaagttgctcttcagcagaaaatctttgtggaacacattccacactttgaaatcttcgtggaacaaaagatatttgtggaaccaatctttgtggaacatattccagctttttgaatgagtgcatatccagtagtacctttaaagtaacactttgtacataacaaatactcagcaaatgtgaaactttatttgctcttacttcaaaattagtccaaaatgttggaaataaaatataagacattgatctagatatgaggtttttctccttcattctcagctgtcgaagaaatcaaagtagcatatgcacaaggttaaaaaccacatatacaaatactatagaacagcttataatgaaaaccttgcctgcctttataaaaaatgtgattatcttcttctgttaatgtcaataaaagatggtttgtcctagaaggtctat

SEQ ID NO: 57530 - DNA, 289 bp, Homo sapiens
ggtcatgaaagcgtggttctgtaagaaatcagagggagaaagggagagaagggggagggagacaacccaaacgttggagggtatttgttgtaaacttcaaacttttggcaggtttgaaatttttcataactccggggaggagcaagaggggtgaaaagaaacaagttctctacttgtgatcagcagctggtcatagtggttgcctggagtatatgcctttttgtatcctttgaatttccagccatgtaaatgtattatttattccaaaaataaagcagatttacatttt

SEQ ID NO: 57531 - DNA, 377 bp, Homo sapiens
  misc_feature 15: n = A,T,C or G
gaagattatataagnattatgccaataaaactcatgcctgaggaagtggttgctccctttctatgggtcagtattggtgcaagaactggaaaccagcccttggagaatagttatacattggccatgattttccacagccctggaaatgcacaattctatcctcctaccaggatgattgttaagttttagctaacatttgattataaaaggccgtaagtatgagtatctctgagataatttgtgtattggaaagaggtgtgtaatagcacttttttaaaaaaacctaggtgtgaaggaattacaagtccagaaggctcaaaatctatagtggaaggaatcatagaggaagaagaagaagatgaggaaggaagtgagtc

SEQ ID NO: 57532 - DNA, 477 bp, Homo sapiens
atggatggtggttttcagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttg

SEQ ID NO: 57533 - DNA, 444 bp, Homo sapiens
  misc_feature 15: n = A,T,C or G
ggaattacaacaatngtcttcaaattttggacccatgaagggaggaaattttggaggcagaagctctggcccctatggcggtggaggccaatactttgcaaaaccacgaaaccaaggtggctatggcggttccagcagcagcagtagctatggcagtggcagaagattttaattaggaaacaaagcttagcaggagaggagagccagagaagtgacagggaagctacaggttacaacaggatttgtgaactcagccaagcacagtggtggcagggcctagctgctacaaagaagacatgttttagacaaatactcatgtgtatgggcaaaaaactcgaggactgtatttgtgactaattgtataacaggttattttagtttctgttctgtggaaagtgtaaagcattccaacaaagggttttaatgtagatttttttttttgcc

SEQ ID NO: 57534 - DNA, 448 bp, Homo sapiens
  misc_feature 442: n = A,T,C or G
aacggaaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacggntgcggg

SEQ ID NO: 57535 - DNA, 465 bp, Homo sapiens
tggaaaaaactactttaaagttcagatggaaccaaaaaagagcccgcatcaccaagtcaatcctaagccaaaggaatgaagctgcaggcatcacgctacctgacttcaaactatcctacaaggctacagtaaccaaaacagcatggtactggtaccaaaacagagatatagatcaatggaacagaacagagccctcagaaataacactgcatatctacaactatctgatctttgacaaacctgagaaaaacaagcaatggggaaaggattccctatttaataaatggtgctgggaaaactggctagccatatgtagaaagctgaaactgggtccccttccttacaccttatacaaaaatcaattcaagatggattaaagacttaaatgttagacctaaaaccataaaaaccctaggagaaaacctagacattaccattcaggagataggcatgggcaaggacttc

SEQ ID NO: 57536 - DNA, 466 bp, Homo sapiens
gagagtcctgaatcataagctcttatgaggattctcaattttccagtacgtttttgagtattttctcttggattagttaagtctttatgatggctctaagctcagctttagaccatggagtaaaagtggttacagcaggcaggctggttgactagagagtctcactttgtaaggcatttgtccaacttcccctttttcattagcctcaaggagaaaaggtaactgagcaaaagggttactgtactcaaagcatcgaggcaaagaagagacagagaaggagcaatccaggttcatgtgctgcatgagcctttcatttgcgttttgtaaagaatcttttaggcaattttagatttgtataatcctttagatgcctctgcatacccgatttaaaatgcatcccgttgtttttgtggcgttttcgatcctttcttttctaatgtgtcccataaataaacagttttatgtg

SEQ ID NO: 57537 - DNA, 339 bp, Homo sapiens
atagcctaatagaaaacaaccgaaaccaaataattcaagcactgcttattacaattttactgggtctctattttaccctcctacaagcctcagagtacttcgagtctcccttcaccatttccgacggcatctacggctcaacattttttgtagccacaggcttccacggacttcacgtcattattggctcaactttcctcactatctgcttcatccgccaactaatatttcactttacatccaaacatcactttggcttcgaagccgccgcctgatactggcattttgtagatgtggtttgactatttctgtatgtctccatctattgatgagggtctt

SEQ ID NO: 57538 - DNA, 210 bp, Homo sapiens
cagggggaagagtcatctaagtttaccatgcagttgtttaccaaaaatagaggaggagagtcttaacttttgctcttggatttaagtcaaggtactgtatagaagttgtgtaaaatcagtatgaaagttcaatgttgctgttcttgctcagtgattttaaagaaattgagtagttcctatgtgatttttttttttcttttctaaactgca

SEQ ID NO: 57539 - DNA, 471 bp, Homo sapiens
  misc_feature 404: n = A,T,C or G
aatggtagatatgatttcttttgtaggctacaacaatgaactgcagattccttgtttgtaatgtaaatgattgaatacattttgttaatatgtttttattcctatgttttgctattaaaaattttataacatttccaagacaaaaattccaagtttatgctttgaagaatttatgtaattaaaatttcactaaactaatctttttagtttaggaattatttgggttttgacactggaagttgcgccaaataagcatcagaaataggagatgcttaacattgctatactacttgtgttggttaggggtttggatttgggggttctttggttttaatttttttttccacatttaaaagccttaaatgtactgtaagcctcagatcgttgtacaactggactgcggntgattgccagtttgtgtactgttgcttggatgcggcacagtggttggtaatggaataaaggatgcat

SEQ ID NO: 57540 - DNA, 338 bp, Homo sapiens
attcacatggctgtgcagccaccaccagcaccatccatctccagaactcttattgttttgcaacactgaaaccgaaaactgagaacatgaggtatttggttttctgttcctgtgttagtttgctgaggatgatggcttctagcttcatccatgtccctgcaaaggacatgatctcattcttttttatggctgcatagtagaatctcctttatttttaaggctgaataataatcccctcgtatgtatgtatgatccatccagtcatccgtcgacaggcatttgggttgcatggggcatctttagtatttcgatcatcaaataattaaataagaggttgg

SEQ ID NO: 57541 - DNA, 381 bp, Homo sapiens
  misc_feature 329: n = A,T,C or G
gaagaatgcacagtgacaaggggagtagctattgggaacagggaactgtcctacactgctattgttgctacatgtatcgagccttgattgctcctagttatatacagggtctatcttgcttcctacctacatctgcttgagcggtgcctcaagtacatccttattaggaacatttcaaaccccttttagttaagtctttcactaaggttctcttgcatatatttcaagtgaatgttggatctcagactaaccatagtaataatacacatttctgtgagtgctgacttgtctttgcaatatttcttttctgatttatttaattttcttgnatttatatgttaaaatcaaaaatgttaaaatcaatgaaataaatttgcagtt

SEQ ID NO: 57542 - DNA, 387 bp, Homo sapiens
  misc_feature 386: n = A,T,C or G
actagaaaagccccttctggtcctggctagggcaaattttagacaactattttctctgtaagtgaagattgtcgtattccaagtctaaaatacacctggatctgtctagtcaatcaacatagcagagacagtcttaaacctaccattgacctgtgtgtaaatttatgtcaatttattgaagtgtaaatttcatcaaaggcattagctgacaggctggtaacagtccacacaagatggtataggcctgaacagtgtagtggcagtaataaagtgggaccattttttccaaatgcgacattgtttctgatgttttttttatgatttgtgcatgtatttttatatgaaaaaaacttacaaagatatgcaaattaaacttctttcagttnt

SEQ ID NO: 57543 - DNA, 471 bp, Homo sapiens
  misc_feature 28, 207, 209: n = A,T,C or G
gtgccgggattataggctgagccctgcncctagcctgttgcagctttttaaagcaggaaaatatccatataaactgttgggttagaatctatattagaatctttcaaactaattgaaaacaggaagactatcatctaagtagccagataatctgggtttcaaaaagttattccatggtactggtttaaaaaatacttttcaagtgtntnaatttttaaagtgtaactaattcttcaaatatgttatgctgttaaaatatgtattccataagtactttttgtatatgtattcttaaattttaaaaagtcaactgaatgcgcaaagatgatataattttggatgtagacatttaaactagattcccagtcctctccttcaaaagcttggtctttgtttttcctatagggaaaaaagtcaaaataagttccaaaaactatcctcaaagtagtattgtgcttgtagtaaatgaag

SEQ ID NO: 57544 - DNA, 200 bp, Homo sapiens
  misc_feature 14: n = A,T,C or G
gaactgcgacaagnatgatctgccgcaagtgctatgctcgccttcaccctcgtgctgtcagctgccgcaagaagaagtgtggtcacaccaacaacctgcgtcccaagaagaaggtcaaataaggttgttctttccttgaagggcagcctcctgcccaggccccgtggccctggagcctcaataaagtgtccctttcattg

SEQ ID NO: 57545 - DNA, 396 bp, Homo sapiens
gaagaaacgcggaaccatggccgctgtggttgctgtttgcggtggtctagggaggaagaagttgacacacttggtaacggctgctgtcagccttacacatcccgggactcacacggtgctttggagaagaggttgttcacaacaggtatccagcaatgaggacctgcttttgtcccagtttgtttctccatttactggatgcatttatggaaggcacattacaggtctttgtgggaagaaacagaaagaaatcacaaaagcaattaagagagctcaaataatggggtttatgccagttacatacaaggatcctgcatatctcaaggaccctaaagtttgtaacatcagatatcgggaataaattctatcacgttaccactaataaacttatttttc

SEQ ID NO: 57546 - DNA, 459 bp, Homo sapiens
  misc_feature 19: n = A,T,C or G
gaaatcatgcaaatcaagnagttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagttggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacatttagatgatccttacggaaaaggaacagattgttccctaaaccagaagaggaggttg

SEQ ID NO: 57547 - DNA, 476 bp, Homo sapiens
aatatctctggtattgaagaggtgaatatgtttacaaaccaaggaacagtgatccactttaacaaccctaaagttcaggcatctctggcagcgaacactttcaccattacaggccatgctgagacaaagcagctgacagaaatgctacccagcatcttaaaccagcttggtgcggatagtctgactagtttaaggagactggccgaagctctgcccaaacaatctgtggatggaaaagcaccacttgctactggagaggatgatgatgatgaagttccagatcttgtggagaattttgatgaggcttccaagaatgaggcaaactgaattgagtcaacttctgaagataaaacctgaagaagttactgggagctgctattttatattatgactgctttttaagaaatttttgtttatggatctgataaaatctagatctctaatatttttaagcccaagccccttggacactgcag

SEQ ID NO: 57548 - DNA, 481 bp, Homo sapiens
tatggcaatgtcttcaattatataagaaatagaacagaagtagtaatcaaaagtagagaattttcctttttggggtagctttacaagaattgcatctcttctgagtattggtggggttttgtcatttcttttgccttatactttttatcatttctaaaatctaaggccttcacccgctaacctaagtttgacttctgattgttggaggatgcttgtgattatttcagaaaaaagcatagtattctttaaaattatttgtcaaattatcctaagtaataaacaaggaataacagattttaatataataatattagaatcaatctctaattacaggtttgtataattttactcaccttctaaaacagaacaattgtatcaaattttacgttgtcattctcttgtgaaagttctagtaagtaatgaaatggtcaaaaagacatggggaagactaataaaatcacaagggaaaacttcagattgg

SEQ ID NO: 57549 - DNA, 426 bp, Homo sapiens
tatacatggtttgaagtctaatgaatacctctatgaagctctaatataataagagggtaacaagctgctagggattcagagggtggatttttcatatctagcaagggtatataaggacaggccttgagtgcacaaggcagcatgtgaatgcaacttgagtgtaattgattttttttttacaagtcagactattgagagttaagaacaatataaacactaaacaagcaaattcaattggacatatacctgttcattcccacaagagactgaactgaagggtgaggcttgtgaatttcattggctgtagtcaatattgcttcactctgttatagttaaaatgtagaccgtctgcctccaaggctgtcaatccggcacctttcaccagcattaagctcacttaaaaatgatttaaaacaacattacatt

SEQ ID NO: 57550 - DNA, 197 bp, Homo sapiens
ggggctaagagtttgagtgacgcctaacagaaaactcgctcttgtaacatctcttgtgaccttggttgacttgctcaaatgctttaaagtcatgcagtgtatttttcgttttttttgtatgttgacgtcttggaatgcacaactttttgttttgtaatgcaaataaagatctgtaatattcagatggacaccttttc

SEQ ID NO: 57551 - DNA, 205 bp, Homo sapiens
gaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatccc

SEQ ID NO: 57552 - DNA, 272 bp, Homo sapiens
  misc_feature 60: n = A,T,C or G
gctaattgataatggaaataatttagtaatggactctacaggatgttaataatgaagccntatgtttatgtctggatttaaaaattttaaacaatcatttactatgtcatttttctttaccttgaagaacataaactgttatttcacttctacaaatcagcaagatattatttatggcaagaaatattccattgaaatattgtgctgtaacatgggaaagtgtaaatgtttttcatggtttctatcaatgtgaaataaaatttaattctgac

SEQ ID NO: 57553 - DNA, 392 bp, Homo sapiens
  misc_feature 137: n = A,T,C or G
atgatatacccatgtaacaaacctatgcatgtatcccctgaatcaaaaataaaagttgaaattaaaaaaaaatccccagtacaagataatttgactaatttcagttaagaatttcagatatccaggctgggcgtggnggctcatgcctgtaatcccaggactttgggaggctgaggtgggtggatcgcttgagcctgggagttcaagagcctggccaacatggcaaaaccctgtctctactaaaaatacaaaaaattagcccggtgtggtggtgcacacctgtagtcccagctacttgggaggctgaggcatgagaatcgcttgagctcgggaaatggagtgagccaagatcacgccactgcactccagcctgggtgacagtgagactccat

SEQ ID NO: 57554 - DNA, 489 bp, Homo sapiens
  misc_feature 420, 470: n = A,T,C or G
gaggcattgaggcagccagcgcaggggcttctgctgagggggcaggcggagcttgaggaaaccgcagataagttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggngattaaaataatttgaaggcgatcttttaaaaagagattaaaccgaaggngattaaaagaccttgaaat

SEQ ID NO: 57555 - DNA, 476 bp, Homo sapiens
atggccggggaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtagggtgattaaaataatttgaaggcgatcttttaaaaagagattaaaccg

SEQ ID NO: 57556 - DNA, 358 bp, Homo sapiens
gactgcgataggaatcatgtctggtcgcggcaaaggcggaaaaggcttggggaagggtggtgctaagcgccatcgtaaggtgctccgggataacatccagggcattacaaaaccggctattcgccgtttggctcggcgcggtggcgtcaagcgcatttccggtcttatctatgaggagactcgaggtgtgcttaaggttttcttagagaacgttattcgagacgccgtcacctatacggagcacgccaagcgcaaaactgtcacagccatggatgtagtatatgccctaaaacgtcaggggcgcactctgtatggcttcggcggctgaatctaagaatacgcggtctcctgagaactt

SEQ ID NO: 57557 - DNA, 468 bp, Homo sapiens
  misc_feature 360, 401, 404, 439, 445: n = A,T,C or G
agtttattggggcaatatactgtcctcaccctcaagtgatcacagattgcccaggggacataagaggtggggttggggagctgcaatttttgctgtcattgaacagcacaggggtacaatttgcatcttttcaggtattcctctttgctagaccttacgggctagaagaaatcaaagagaatgaaatggtagagaattttttttggagaaaaatatcatcacacatattaccaatgtagaacaattatgattataccgttttaaggatctcagatattttcctgcttagagtctatgtattttcatttaattattaaaaagtacaggattatgtaattttttttgcattttatgccttgnggttagaccctaagtattaaaaattgcctctacttaacagnggngcagtcttaaaaattctggctatggtagcaaaggntctggngttggaatattgttggcctgtta

SEQ ID NO: 57558 - DNA, 325 bp, Homo sapiens
gttcaaagcatgaaatggatacttatatggaaattctgctcagatagaatgacagtccgtcaaaacagattgtttgcaaaggggaggcatcaagtgtccttggcaggctgatttctaggtaggaaatgtggtagcctcacttttaatgaacaaatggcctttattaaaaactgagtgactctatatagctgatcagttttttcacctggaagcatttgtttctactttgatatgactgtttttcggacagtttatttgttgagagtgtgaccaaaagttacatgtttgcacctttctagttgaaaataaagtgtatattttttct

SEQ ID NO: 57559 - DNA, 287 bp, Homo sapiens
  misc_feature 106, 265, 274, 286: n = A,T,C or G
gaggcattgaggcagccagcgcaggggcttctgctgagggggcaggcggagcttgaggaaaccgcagataagtttttttctctttgaaagatagagattaatacanctacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggtngagatgaancttcttcatggng

SEQ ID NO: 57560 - DNA, 464 bp, Homo sapiens
  misc_feature 407: n = A,T,C or G
ggctgtggaagggtgggggtgggtcattatagtattcaggatttacagtgcagtattcacgtgtaacttttaagttttcagtacagtgcttttatacctttaatgcaatgttgtattcatttgggtactattgtgtagtatttaggatgtatgcatgtttgtttatatgtaagcttggttggtgctttcgcttttgtgctacctttcttggatttttgtaccagagatgtgctaaactgatgaaatacattgagaaagtttccatcttattcttttatatgggactgatgatgtgtgttggggtagactgctcctgcggagtttggaagaagtcaccagcaaagccggcctaaccaagaaaagtcaaggcccttcatgaccttgctgggcacagaaaacaccctcgnggagtacactaatttgaactggactggtctcagtgtgagcacttggcacactttact

SEQ ID NO: 57561 - DNA, 397 bp, Homo sapiens
  misc_feature 3, 50: n = A,T,C or G
cantgaacctagttcaactttaaatttgcccacagaaccctctaaatccntttgtaaatttaactgttagtccaaagaggaacagctctttggacactaggaaaaaaccttgtagagagagtaaaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagtataagtaacatgaaaacattctcctccgcataagcctgcgtcagattaaaacactgaactgacaattaacagcccaatatctacaatcaaccaacaagtcattattaccctcactgtc

SEQ ID NO: 57562 - DNA, 400 bp, Homo sapiens
gccagaggacttggatctgagctaaaggacagtattccagttactgaactttcagcaagtggaccttttgaaagtcatgatcttcttcggaaaggtttttcttgtgtgaaaaatgaacttttgcctagtcatccccttgaattatcagaaaaaaatttccagctcaaccaagataaaatgaatttttccacactgagaaacattcagggtctatttgctccgctaaaattacagatggaattcaaggcagtgcagcaggttcagcgtcttccatttctttcaagctcaaatctttcactggatgttttgaggggtaatgatgagactattggatttgaggatattcttaatgatccatcacaaagcgaagtcatgggagagccacacttgatggtggaat

SEQ ID NO: 57563 - DNA, 394 bp, Homo sapiens
  misc_feature 41: n = A,T,C or G
cgtgaggaaagccgtgccgttgcgttccaaggcatctgttncccgcggagtatacaccatgagcaaagctcaccctcccgagttgaaaaaatttatggacaagaagttatcattgaaattaaatggtggcagacatgtccaaggaatattgcggggatttgatccctttatgaaccttgtgatagatgaatgtgtggagatggcgactagtggacaacagaacaatattggaatggtggtaataccgaggaaatagtatcatcatgttagaagccttggaacgagtataaataatggctgttcagcagagaaacccatgtcctctctccatagggcctgttttactatgatgtaaaaattaggtcatgtacattttcatattagactttttggt

SEQ ID NO: 57564 - DNA, 213 bp, Homo sapiens
aagggacaaaaggtgggtgaattttctggagccaataaggaaaagcttgaagccaccattaatgaattagtctaatcatgttttctgaaaacataaccagccattggctatttaaaacttgtaatttttttaatttacaaaaatataaaatatgaagacataaacccagttgccatctgcgtgacaataaaacattaatgctaacactttttt

SEQ ID NO: 57565 - DNA, 380 bp, Homo sapiens
ataagagagaaaagggaaaaaattaaagagatgatgaaacattcttgggataactataggacatatgggtggggacataatgaactcagacctattgcaaggaaaggacactcccctaacatatttggaagttcacaaatgggtgctaccatagtagatgctttggataccctttatatcatgggacttcatgatgaattcctagatgggcaaagatggattgaagacaaccttgatttcagtgtgggaagaggaagaacgtctgagaaataaaattcgagctgatcatgagaaggccttggaagaagcaaaagaaaaattaagaaagtcaagagaggaaattcgagcagaaattcagacagagaaaaataaggtagtcc

SEQ ID NO: 57566 - DNA, 358 bp, Homo sapiens
  misc_feature 47: n = A,T,C or G
ctcccgctcatagctgcttttggcgcgaaagatgccggttctgggtntgactcaaaccctgccccgcctgagtctcaggagaagaagccgctgaagccctgctgcgcttgcccggagaccaagaaggcgcgccgatgcgtgtatcatcgagaaaggagaagaacactgtggacatctaattgaggcccacaaggaatgcatgagagccctaggatttaaaatatgaaatggtggctgctgtgtgaataaataattcctgaagaatgaagaagattaattttgggagttctttgacgaactttgatatgtggaaaaagtatttataatttattgtaagaagaaagtaaaatattctagc

SEQ ID NO: 57567 - DNA, 109 bp, Homo sapiens
  misc_feature 2, 20, 27, 33, 35, 37, 38, 48, 52, 53, 54, 57, 61, 67, 69,70, 72, 73, 74, 84, 96, 101: n = A,T,C or G
gngggccgaggaagggaggnaagggtnaggggngncnnctggaaaaangggnnngcngagnggggcngnncnnnaacgagaagncttgaaaatgcncgggnggcacaac

SEQ ID NO: 57568 - DNA, 308 bp, Homo sapiens
  misc_feature 6, 11: n = A,T,C or G
atactnaggtnttatctaaaaagtaaatgtatttgcctttgacaaaagactgacacaagagcaaataagctttaaaatcgggtgttatgtgctttcctccatttttgagcatattatccaaaatggtctgtataatataaatgagaatgatgcagtttaagtaagccttgttataccattgtcatggacccctgtcataaagccatttcttggtttgtttgggaaagaggcatatgggatttatacagattcacttgtaaatgttggattggggatttttgtgtaaattttctcaaataaaggctagc

SEQ ID NO: 57569 - DNA, 122 bp, Homo sapiens
  misc_feature 14, 20: n = A,T,C or G
acttgaaacatgtntaaagnatgtgttgttttgcaggactttttgcatacttatttctacatggtttaaatcgactgtttttaaaatgacacttataaatcctaataaactgttaaacccat

SEQ ID NO: 57570 - DNA, 400 bp, Homo sapiens
  misc_feature 3, 41: n = A,T,C or G
aanatacctagttaagaggatgatttctctttaatcgtttntttgttctgaaaattaaaatcttttgaggcacatgaagtgggcaccatatatcatctagagtccttactggtattcaggatgaaaatgttcacgctgcattaattgtcatttttctctcccatgttctttctcaccttgatacgttaatactgataatggataaagagtgagtttttataataaatggttttggaaaggtattcataggaaccgcggttatttacttaaggttatggagtaaactagcttggaccttgggctgcaggacgactaggattcacccataacgacacagtgccctatgtttcttaacttcttgttgccatttgaaactctgtactcttatgtttaaagggtc

SEQ ID NO: 57571 - DNA, 313 bp, Homo sapiens
  misc_feature 33, 39: n = A,T,C or G
tcattaagagaataaaaaagatgaacagagcantaacangtaactaggctaagtcagcaataaaaatcttccatcaaagtaaattctaggaccctgatgccttcattactgaattctatgaaacaattaagaattaatatcagtccttctcaaactcatccaaaaaattgaataggagggaacactttctaactcatcttgtgagaccagaatttccctaatatgaaagccagacaaggacattgcaagaaaaaaatcaactattacaggccaatcaatatccctgatgaacatagttctaaaacttgcccac

SEQ ID NO: 57572 - DNA, 120 bp, Homo sapiens
  misc_feature 3: n = A,T,C or G
ctnctgtctcaacctcccaagtaggattacaagcatgcgccgacgatgcccagaatccagaactttgtctatcactctccccaacaacctagatgtgaaaacagaataaacttcacccag

SEQ ID NO: 57573 - DNA, 163 bp, Homo sapiens
tgcaagcaacatgtgcacaggcacgcacatgtgtgcacgcacacatacaatctgggttatctttgtgctatatagtggattataattctgtgaaaccaagtttgtatattgaattacattaaggagtgttctttaaaaagagaaataaatatacaattacatg

SEQ ID NO: 57574 - DNA, 398 bp, Homo sapiens
  misc_feature 41, 77, 386: n = A,T,C or G
attagggaaatcgcgacacatttgtagtcattgtatcacgntttacaatgaacgcagtgcagagccccaaagctcangctattgttaaatcaataatgttgtgaagtaaaacaatcagtactgagaaacctggtttgccacagaacaaagacaagaagtatacactaacttgtataaatttatctaggaaaaaaatccttcagaattctaagatgaatttaccaggtgagaatgaataagctatgcaaggtattttgtaatatactgtggacacaacttgcttctgcctcatcctgccttagtgtgcaatctcatttgactatacgataaagtttgcacagcttacttctgtagaacactggccataggaaatgctggttttttgnactggactttac

SEQ ID NO: 57575 - DNA, 381 bp, Homo sapiens
tagagcataaggagattttggatcagctggagtcactcaaattagaaaatcgtcatctttctgaaatggtgatgaaattggaattgggtttacatgaggccaacccatggccagcacagacatgatggaataaagactgagcactacaaaacagatcttcattctccaagaggacaagcgtcggatagtataaaccccatgtctagggtgctaagccccctgagtcctcaaatcagcccttgcagctccaccagtgttccttgcctgtatctccccttggttcaatagctaccagatttttggaagaggaggactgaggtctcgtcacattctagagcgcttggatgcccatattgaagactaaaaagagagagtgaaaag

SEQ ID NO: 57576 - DNA, 365 bp, Homo sapiens
aggagatgagagaaatcagaagaaaacttagggagctgtttttgaggaattgtctgcgtatccttatgggggagctctctaatcaccatgaccatcatgatgaattttgccttatgccttgactcctgccatttatcatgagattaatactgtgattcccgctgttttctttttccttgcattttcctaatatgcctttactgatccgtttgctgtgaaccctatgttatttccatgtgtcaagtgggtcttgtgttgccagcttctatttgaagattgcctttgcactcagtgtaagtttctgcagcagtagtttcacccatttgcatggaaaaatttaaagctaataaagcaatttaaaaagc

SEQ ID NO: 57577 - DNA, 395 bp, Homo sapiens
  misc_feature 1, 20, 50, 53: n = A,T,C or G
natgggcccaagcaggaggntttcaacctagtcacagagcagcacctacnttnctcctcatttttataacctggcaaaatcttgttaatgtcattgctaaaaaataaataaaagctagatactggaaacctaactgcaatgtggatgttttacccacatgacttattatgcataaagccaaatttccagtttaagtaattgtctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaatttccaggaaaaaataaaaagagtatgagtcttctgt

SEQ ID NO: 57578 - DNA, 288 bp, Homo sapiens
aacgcaaagtagaggaaatggaagtggatgacttctatgatttaatcaaacggctctataatgaagataatgtctcagaaaatgtgggttctgtgtgtggcactgatttatcaagacaagagggacatgcttccccttgtccacctttgcagcctgtttctgtcatgtagtttcaacaagtgctacctttgagtgtaaactaaggtagactactttgggaatgagaacatgcaaaatcaggaaaggctgtagaaggaaatataccttaacaggctgatttggagtggg

SEQ ID NO: 57579 - DNA, 396 bp, Homo sapiens
  misc_feature 1, 5, 31, 32, 35, 38, 40: n = A,T,C or G
ntcgnttgagggaagaacttgaagaagggcnnaangtnangaggcgacgggacagttagctggggccttgaagatgatgaagatatgacacttacaaggtggcaggcatgattattgggccaccaaggacaaattatgaaaacagaatatatagcctgaaagtagaatgtggcctaaatacccagaagctcctccgcagttagatttgtaacaaaaattaatatgaacggaataaataattccagtgggatggtggatgcccggagcataccagtgttagcaaaatggcaaaattcatatagcattaaagttgacttcaagagctaagacgtctaatgatgtccaaagaaaatatgaagcttccacagccaccagaaggacaaacatacaacaatt

SEQ ID NO: 57580 - DNA, 281 bp, Homo sapiens
  misc_feature 1, 3, 49, 51: n = A,T,C or G
nantgccccgcggtggctcatgcctgtaatcccagcactttgggaggcntnggcggatggatcacaaggtcaggagttcgagaccagcctggccaagatggtgaaaccccgtctctactaaaaataaaaacttagccaggcgtggtggcaggcgcctgtagtcccagctactcgggaggctgaggcaggagaattcctagaacctgagaggcggaggttgcagtgagccgagatcgtgccactgcactctagcctgggtgacagagcgagactccatctcg

SEQ ID NO: 57581 - DNA, 398 bp, Homo sapiens
  misc_feature 39, 74: n = A,T,C or G
tgggtgagtaaaactattttgacgtgggagcgttttcanttaggagtttagtcttgacgaaagtgtcccgtgcnggaattggactccgaggagggttacagtatctcctgacgggacctgccactcgcatctgggcaatgttgacatttgaggtggcaggcaggatgcctgccttctaatatatttgggtgagtaactgagccagccaagggaaggttgaatgattaaatcagaaatgggattcttggtaaactgaagacttttatttgggaatgaaaaaccttaaaaaaatctcttcatcgttgaactgtgcattttccctgcattttttcccaacaaaattttgttgggggttatgtactgaagaatgaacagatgagtaagtggaggtggtatgt

SEQ ID NO: 57582 - DNA, 396 bp, Homo sapiens
  misc_feature 72: n = A,T,C or G
cacctttttggagttagtcatggtaagtcattagtgatttttctgaacagttcttaatttaaaatacttcanaggaagtaaaggtcatggcttagctgaaggaaatgctccagaaattggactgtgtaaaccatcagtacaataatacgctgtgtatgtatgtgtatataaaatgagaattatggcataattggagcatttgcattaatcaacaaactcacattgagacaaaacttagttttacagctgtcttgattaaagccaagtgttccatgttgctgtgaagaatagcctctttcaaatactttggaaagtagttacttggaaacttgtaaaggtattacatttttatatttaaacacctatagagatcttcaattccttgagtctgagctt

SEQ ID NO: 57583 - DNA, 400 bp, Homo sapiens
  misc_feature 41: n = A,T,C or G
tctagtttgttttgtgtttttacatctatttctaccatacntttagagtaggatggtgagatgcatttctaaatatttttaactactcagtctggatggttaggcttcaagaaaaggaatttatttagtctgaaataaagcaattttgccatttaaaattgaattactttgtagtttaatgattactattgagcaaacaaatctttacagtaatataagtcagcaaaagttttttaaaaggtttaaatccctccttccttacatctatttcattgcttttttaggtttgggaagtaaagcaccagaggaagcatgtgtaaatccttgtataatcgcaggctgtaagtctttagcatctcaggaagttactaacttcaaactaagtatataggtagagttt

SEQ ID NO: 57584 - DNA, 327 bp, Homo sapiens
tcgagcagatttttaggtctttcgtggtcagtaaattccgggaaattcaacaggagctttccagtggaaggaatgaaggccagctgaatggtgaaacaaatacacccattgaaggaaaccaggcgggtgatgcagctgcctctgccaggagtctaccaaatgaagaaatagtgcagaagatagaggaagtactttctggggtcttagatacagaactacgatataagccagacttgaaagagggctccagaaaaagtagatgcgtatctgtacaaacagatcctactgatgaaattcccactaaaaagtcaaagaagcataaaaagc

SEQ ID NO: 57585 - DNA, 359 bp, Homo sapiens
  misc_feature 341: n = A,T,C or G
gtcatgagaaagaatttgcgtttttgttgttgttacaaatatgagttctcagtttttcttttacaaaaattcaaactttctgggctgggcatggtggctcatgcctataatcccagcactttgggaggctgaggcgggtggatcacctgaggtcaaggagctcgagaccagcttggcaacatagtgaaactccatctctactaaaaatacaaaaaatagtcaggtgtggtggtgggtgcctgtagtcccagctactcgggaggtggaggtagggagaatcacttgaacctgagaggcagaggttgcaatgagccaatatcacaccattgtctccagcctangcgacagagtgagacttg

SEQ ID NO: 57586 - DNA, 392 bp, Homo sapiens
  misc_feature 1, 31, 37, 71: n = A,T,C or G
nttacattttatagaaaggaacctttcactnttgagntttactacagctctcctcaggatttgccctatcnagatcctgctatagctcagttttcagttcagaaagtcactcctcagtctgatggctccagttcaaaagtgaaagtcaaagttcgagtaaatgtccatggcattttcagtgtgtccagtgcatctttagtggaggttcacaagtctgaggaaaatgaggagccaatggaaacagatcagaatgcaaaggaggaagagaagatgcaagtggccaggaggaaccacatgttgaagagcaacagcagcagacaccagcagaaaataaggcagagtctgaagaaatggagacctctcaagctggatccaaggataaaaagatggcc

SEQ ID NO: 57587 - DNA, 397 bp, Homo sapiens
  misc_feature 1, 10: n = A,T,C or G
naatggaccnagacgcggtcgtaagggctgaggatttttggtccgcacgcttttgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgacttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgca

SEQ ID NO: 57588 - DNA, 394 bp, Homo sapiens
  misc_feature 4: n = A,T,C or G
gatngtaacagctggataataatgaagatctttcaaatttagataaaatcaaatatataaaagctgtctttcaggaaaaaaggtagtatagtgatggttactggcaaagtaaatattaaaaagtttcaagaatataaacttccaaagagtagtattttagaaggttgattaatattttataatatctcataaattaaattaaaaccaaatgaatcactacaagtctctgattagttcttaattttcaggggttgatgatctctaaaacaaatcactgactagttttgattatttaaatgagtgaatggttttaatgatcataaaaggagacttgagcctttgatgtatgctaggttaaatttcggctgatttttttcaagtggagaagtgcatg

SEQ ID NO: 57589 - DNA, 179 bp, Homo sapiens
atgatgatgatgaggacaactctctttttccaacaagagagccaagaagccattttttccatttgatctgtttccaatgtgtccatttggatgtcaggtgctattcacgagttgtcattgctcagatttaggtttgacctcagtcccaaccaacattccatttgatactcgaatgcttg

SEQ ID NO: 57590 - DNA, 286 bp, Homo sapiens
  misc_feature 5: n = A,T,C or G
ccagnttattactctaaaaagagaattacacatgccaaatggaccaatgtccatttgcttattggaggcaaagctacaatagaagtcagagcatcaccagaacggtctttaatgagcatggaacctgagcaaagggaataggtgggatgaattttttttttaattgtgaaacaattcataagcacaatatgatttacagaataataaacattcatgtacccactatcaggttaagaaatagaacatttattaatatgtaggaatgttaagaaataaaacatttaat

SEQ ID NO: 57591 - DNA, 142 bp, Homo sapiens
  misc_feature 3, 22: n = A,T,C or G
ctngaggaaaccgcagataagnttttttctctttgaaagatagagattaatacaactacttaaaaaatatagtcaataggttactaagatattgcttagcgttaagtttttaacgtaattttaatagcttaagattttaaga

SEQ ID NO: 57592 - DNA, 179 bp, Homo sapiens
  misc_feature 2, 4: n = A,T,C or G
tnangtggaattaagaaatctggcaaaaagtaagctgttccttgtgcctgaggagatggtgaccctttatttcatctgtatttaaacctctctattccctgccataacatcttttgccacgtatagctggaattaagtgttgtcttggagctgttgtacatttaagaataaacttttgt

SEQ ID NO: 57593 - DNA, 146 bp, Homo sapiens
  misc_feature 52: n = A,T,C or G
ctaaagctttttttaaaaaaaggtggaaaataggaactgtcttttaaggttnatggtataaatgatgaagttgaagtgatgtttgaaagattaatgagatacaatttatattatttggtaaggttttttttttccctccaaagatg

SEQ ID NO: 57594 - DNA, 153 bp, Homo sapiens
  misc_feature 3, 53, 78: n = A,T,C or G
cantgacccggattggtccaacctggtagatgctgccaaagcctatgaggttnagagagcctcattttttgctgctangtgatgaaaaccatcgccccttgagtgctgcatccaacagtgatcagctggaggaccaggctctggcccagatga

SEQ ID NO: 57595 - DNA, 397 bp, Homo sapiens
  misc_feature 37, 368: n = A,T,C or G
cttgaggaaaccgcagataagtttttttctctttganagatagagattaatacaactacttaaaaaatatagtcaataggttactaagatattgcttagccgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaatacccaatagaagggcaatgcttttagattaaaatgaaggtgacttaaacagcttaaaggttagtttaaaagttgnaggtgattaaaataatttgaaggcgtctt

SEQ ID NO: 57596 - DNA, 327 bp, Homo sapiens
  misc_feature 7, 14, 30, 37, 41, 48: n = A,T,C or G
cttaccngagagtnggcatataatgtattnacttggnagcnagacttnctgggtttgaatacgggatgaaaattcaccagtcttttgaccttgggaaagttactaaaccttcctatacaccagtttcctcatccgtgaaatgaggcaaattatagcacctacctcttagggttgttataaaccttaaatcagttaagtacaagtaaaggccttagaacagcacctggcacattgtaagaaatgtctaaaggttcattgctatcatttattcatttccacatctcattcctaaaataaaaggtgttataaaattgccagtataatttg

SEQ ID NO: 57597 - DNA, 274 bp, Homo sapiens
  misc_feature 29: n = A,T,C or G
aaaagattggacaaagtctatgattaagngattaaagaaatctaaataaacttttggggcttttaggtttgccatttctgtaattgagaaatgttttgaagtttaagtagatcacgtcatcatatataaggtgatttataaactgagcagtgaatgctcagatgtttaaaaaagaaaatccaactgcacttatgtatgtttttgtttaacttgtggcaaagacttatggataggtgcaaaaaaataaatcctcttttgcaacccagactcattg

SEQ ID NO: 57598 - DNA, 398 bp, Homo sapiens
gtattttgaaagattgatgtttgcattttacttcagtatttaattgctaaagacatcacactagaaacatatgcaatgtttttattacatacttctactggacatcacagaattctttgggttctttgtaatttaatgaataggtctgaaaacttatgaccaatacttgttataacttagaggactttgttttattccaaataaggaatgaatttgcatttaaaatcttaatgaatgttttcaaaactgaatagataacatagtactctaactaaagtctccaagttatgtattataatattacatagtagtatgcttaggctttactatgtattagccttttgttggctgtgtatgtattttaccatatgggtttaatgataatggtgtatgactgc

SEQ ID NO: 57599 - DNA, 400 bp, Homo sapiens
  misc_feature 41, 82: n = A,T,C or G
tcatgacagaagggagtttgctaaatttgaaaaggagaaanttaatgccaaatgggacacgggtgaaaatcctatttataanagtgccgtaacaactgtggtcaatccgaagtatgagggaaaatgagtactgcccgtgcaaatcccacaacactgaatgcaaagtagcaatttccatagtcacagttaggtagctttagggcaatattgccatggttttactcatgtgcaggttttgaaaatgtacaatatgtataatttttaaaatgttttattattttgaaaataatgttgtaattcatgccagggactgacaaaagacttgagacaggatggttattcttgtcagctaaggtcacactgtgcctttttgaccttttcttcctggactattgaaatc

SEQ ID NO: 57600 - DNA, 100 bp, Homo sapiens
ccgagcttcgcaatgccgcctaaggacgacaagaagaagaaggacgctggaaagtcggccaagaaagacaaagacccagtgaacaaatccgggggcaagg

SEQ ID NO: 57601 - DNA, 309 bp, Homo sapiens
  misc_feature 26, 52: n = A,T,C or G
agtcattccaggtggatctgagtttntatattcaaacttttaatacagtttntgagttttgtgtgacttgaatttttaatctttctgtaaaatacgtaacttaaatgaacatattaaatgtgtatcttttcttcagataccagatttgatataatgttgtaacataggtgtgtagatagtggatcctggacggaactggcttctttatcgagaagaatataattctgcatgaggacttaatgaatccaaacctgtgtcatgcctgtgtgcatacccaattaaacactggaaataaaaattgttttggtg

SEQ ID NO: 57602 - DNA, 398 bp, Homo sapiens
  misc_feature 41: n = A,T,C or G
aaaattgtacagtgtttccggcccttctcagttgtggacgnttatcactggcgttatccttcttgcagttggcatttggggcaaggtgagcctggagaattacttttctcttttaaatgagaaggccaccaatgtccccttcgtgctcattgctactggtaccgtcattattcttttgggcacctttggttgttttgctacctgccgagcttctgcatggatgctaaaactgtatgcaatgtttctgactctcgtttttttggtcgaactggtcgctaccatcgtaggatttgttttcagacatgagattaagaacagctttaagaataattatgagaaggctttgaagcagtataactctacaggagattatagaagccatgcagtagacaagatcc

SEQ ID NO: 57603 - DNA, 100 bp, Homo sapiens
  misc_feature 8, 15, 30, 32, 68, 69, 78, 87, 94, 99: n = A,T,C or G
tcaccctnccgagtngaaaaaatttatggncnagaagttatcattgaaattaaatggtggcatgaggnntaccaggcntatcgcggngattggntcccnt

SEQ ID NO: 57604 - DNA, 381 bp, Homo sapiens
  misc_feature 10, 13, 356: n = A,T,C or G
gattgaaaanttnagagctgaagacggtgaaaattatgacattaaaaagcaggcagagatcctacaagaatccaggatgatgatcccagattgccagcgcaggttggaagccgcatatttggatcttcaacggatactagaaaatgaaaaagacttggaagaagctgaggaatataaagaagcacgtttagtactggattcagtgaagttagaagcctgaaacttttctcgtatggggtggtttttgcattaaatcctggggtccattttacaatccattatttttgaccactgctatgtgttcaagtagtatgagaatgtgattgtttttatctggtacatatatatttctttgnctaatttaatatgtcaaataaatga

SEQ ID NO: 57605 - DNA, 329 bp, Homo sapiens
  misc_feature 11, 22, 35, 39, 55, 58: n = A,T,C or G
aagacgagggnggatgaaaaancagcttgctcacntaantatatttgaatgtttnaanattttaaataatcatcctataaagaagttgtcagactcacttgctgcaccactcaaaggagagagaaccgttgggtagattcatatgaatgtgaaaataacttcagctaaagcaaacaatgtgtcagattgaaagaacagtgacttgacaagcctaattttactttccaggtagtgtttaccttccgtaagtgaacttagggaatgagtccaagaatactgcctggaattccaggagactgaatgtatgtgctccggaaaaatcaatttgc

SEQ ID NO: 57606 - DNA, 306 bp, Homo sapiens
  misc_feature 4, 30, 41, 48: n = A,T,C or G
atgnttgtcattttgaaatacttaatgccnagtaacaatgnttgcttnggaaatttggaagatggttttattctttgagaagcaaatatgtttgcattaaatgctttgattgttcatatcaagaaattgattgaacgttctcaaaccctgtttacggtacttggtaagagggagccggtttgggagagaccattgcatcgctgtccaagtgtttcttgttaagtgcttttaaactggagaggctaacctcaaaatattttttttaactgcattctataataaatgggcacagtatgctccttaccg

SEQ ID NO: 57607 - DNA, 376 bp, Homo sapiens
  misc_feature 372, 375: n = A,T,C or G
tggtataaagactataaatagccttatgtcagtgcaggtttgactttactgccagaaaagttgcatacagtcttttgcttttcagagcttttttgatttaggaattgcagatatggaattgaggatctgtacaaatcttcagacataaataatacaaagttctagaacacccctctttaagaatagtttgtgtggatatcctttatctttttcagataataacatttactgaacacatttttaaaaatgggccgggcgcggtggcttatgcccataattccagcactttaggaggccaaggtgggcggatcacctgaggtaaggagtttgagaccagcctggccaacatggtgaaaccttgctctactattnttnc

SEQ ID NO: 57608 - DNA, 400 bp, Homo sapiens
  misc_feature 7, 16, 365, 384: n = A,T,C or G
aaaattnaaaagtgantttaaagcatttaactggccagttttgattgcaaatgctgtaaagatatagaatgaagtcctgtgaggccttcctatctccaagtctatgtattttctggagaccaaaccagataccagataatcacaaagaaagcttttttaataaggcttaaaccaagaccttgtctagatatttttagtttgttgccaaggtagcactgtgagaaatctcacttggatgttatgtaaggggtgagacacaacagtctgactatgagtgaggaaaatatctgggtcttttcgcagtttggtgcatttgttgctgctgttgctactgtttgcctcaaacgctgggttaaacaacgttnaactcttagcctacaaggnggctcttatgacatag

SEQ ID NO: 57609 - DNA, 375 bp, Homo sapiens
  misc_feature 329, 332, 345: n = A,T,C or G
cggaatggagaatacccatctgtaatacaggtcctgtcattttattcatctcaaattattttgaattcttcccaaatggctgctggatttaggtggtaataggggctgtgggccataaatctgaagccttgagaaccttgggtctggagagccatgaagagggaaggaaaagagggcaagtcctgaacctaaccaatgacctgatggattgctcgaccaagacacagaagtgaagtctgtgtctgtgcacttcccacagactggagtttttggtgctgaatagagccagttgctaaaaaattgggggtttggtgaagaaatctgattgntgngtgtattcaatgngtgattttaaaaataaacagcaccaccaat

SEQ ID NO: 57610 - DNA, 344 bp, Homo sapiens
tgtttatatttgtaccccaaataacatcgtctgtactttctgttttctgtattgtatttgtgcaggattctttaggctttatcagtgtaatctctgccttttaagatatgtacagaaaatgtccatataaatttccattgaagtcgaatgatactgagaagcctgtaaagaggagaaaaaaacataagctgtgtttccccataagtttttttaaattgtatattgtatttgtagtaatattccaaaagaatgtaaataggaaatagaagagtgatgcttatgttaagtcctaacactacagtagaagaatggaagcagtgcaaataaattacatttttcccaag

SEQ ID NO: 57611 - DNA, 400 bp, Homo sapiens
  misc_feature 3, 7, 27, 30: n = A,T,C or G
gcngggncttctgctgagggggcaggnttnagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtag

SEQ ID NO: 57612 - DNA, 397 bp, Homo sapiens
  misc_feature 1, 14, 50, 53: n = A,T,C or G
naatggccccaggnccgggtggttgctgccgaaatgggcaagttcatganttntgggaaggtggtgcttgtcctggctggacgctactccggacgcaaagctgtcatcgtgaagaacattgatgatggcacctcagatcgcccctacagccatgctctggtggctggaattgaccgctacccccgcaaagtgacagctgccatgggcaagaagaagatcgccaagagatcaaagataaaatcttttgtgaaagtgtataactacaatcacctaatgcccacaaggtactctgtggatatccccttggacaaaactgtcgtcaataaggatgtcttcagagatcctgctcttaaacgcaaggcccgacgggaggccaaggtcaagtttgaagagagat

SEQ ID NO: 57613 - DNA, 346 bp, Homo sapiens
cccgccggactttctgtaagaagtgtggcaagcaccaaccccataaagtgacacagtacaagaagggcaaggattctctgtacgcccagggaaagcggcgttatgacaggaagcagagtggctatggtgggcaaactaagccgattttccggaaaaaggctaaaactacaaagaagattgtgctaaggcttgagtgcgttgagcccaactgcagatctaagagaatgctggctattaaaagatgcaagcattttgaactgggaggagataagaagagaaagggccaagtgatccagttctaagtgtcatcttttattatgaagacaataaaatcttgagtttatgt

SEQ ID NO: 57614 - DNA, 140 bp, Homo sapiens
ctgcccagaaagcagttaacagtgccaccggtgttccaactgtttaaaattgatcagggaccatgaaaagaaacttgtgcttcaccgaagaaaaatatctaaacatcgaaaaacttaaatattatggaaaaaaaacattg

SEQ ID NO: 57615 - DNA, 395 bp, Homo sapiens
  misc_feature 2, 4, 70: n = A,T,C or G
gncncgtttctctaaaaatagtcctgttttcagtatgaatctaagagaacattaccggagaaaataaagntactcatttatagttactaataataagttagtgattaacttaccacaattggataaaatataaaactattcttcagcacatttatacctaaattagtgaagtccatttgtgaagttcatttggcatctgcagttaagagttaaccatgtataaaatccctcccaaagaacataatcatcattgttagaaccaaatcctcttataaagaacaaatataaaaaagttttctgtggtgaagctattttatagatttgatttccggagtagaattttaccttaattcacttaaagaaaattaaccattttttggtccaacttcagatat

SEQ ID NO: 57616 - DNA, 328 bp, Homo sapiens
  misc_feature 41, 286: n = A,T,C or G
actgtcaatgaaaaccttgaaaactattacctggaggtcanttaacttgagaagtttgacataaagagcttctgcaagatcctggggccattatcctactccaagatcaagcatttgcgtttggatggcaatcgcatctcagaaaccagtcttccaccggatatgtatgaatgtctacgtgttgctaacgaagtcactcttaattaatatctgtatcctggaacaatattttatggttatgtttttctgtgtgtcagttttcatagtatccatattttattactgnttattacttccatgaattttaaaatctgagggaaatgttttg

SEQ ID NO: 57617 - DNA, 110 bp, Homo sapiens
gtgctatgtaatacatctgggcatatggagaagtgaaattatattccatccaagtgaaatgggcaatttaatgtaaggttttttcaggtattaaagctaacaagaccaat

SEQ ID NO: 57618 - DNA, 276 bp, Homo sapiens
  misc_feature 14, 41: n = A,T,C or G
aaaactccttccgncccaggtttcttcttctcttaaggagntttgttctcaccaacccgctgccttcatgctgccttcaaagctagatcatgtttgccttgcttagagaattactgcaaatcagccccagtgcttggcgatgcatttacagatttctaggccctcagggttttgtagagtgtgagccctggtgggcagggttggggggtctgtcttctgctggatgctgcttgtaatccatttggtgtacagaatcaacaataaataatatacacg

SEQ ID NO: 57619 - DNA, 259 bp, Homo sapiens
tggccggattccagactcgtgggggaaaggctgtttccaaggcaggaaaggtaaagagacaaagaaagtgccttgtacagatgcaaacggaggtgtagactgtgcagctgccaaagtggtgacaagcaatccagaggaccatgaaaggatcttaatgcaagtcatgaacttgaatgtgccgatgaggcctggcattcttgtccagagacagagtaaggaagtgttggccacacccttagaaaacagaagggacatggag

SEQ ID NO: 57620 - DNA, 136 bp, Homo sapiens
ctgaagtgaagagatattagctttggctgttcacaaaatagagcatcatgattttcagtgtttgagagaaaattgatggaaaaagtttgcagtacttgacatgtatttgcatgcacaaaataaaattatttgtcca

SEQ ID NO: 57621 - DNA, 400 bp, Homo sapiens
tgccagagtaaagtttctaaaataacattcctctcacttgtaccccactaaaagtattagtctacacattacattgaagttaaacacaaaattatcagtgttttagaaacatgagtccggactgtgtaagtaaaagtacaaacattatttccaccataaagtatgtattgaaatcaagttgtctctgtgtacagaatacatacttattcccatttttaagcatttgcttctgttttccctacctagaatgtcagatgtttttcagttatctccccatttgtcaaagttgacctcaagataacatttttcattaaagcatctgagatctaagaacacaattattattctaacaatgattattagctcattcacttattttgataactaatgatcacagcta

SEQ ID NO: 57622 - DNA, 392 bp, Homo sapiens
agaagaataggattcgatgtcgtcaccgttgtccggtttccgggggcctttatcgagagttgggttagagcctccacctggaaaacgtgaatgccgagttgggcagtatgtggtcgacctgacttcttttgagcagttggcactacccgtcttgaggaatgccgactgcagcagtggcccagggcaaagagtgtgcgtcatcgatgagattgggaagatggagctcttcagtcagcttttcattcaagctgttcgtcagacgctgtctaccccagggactataatccttggcacaatcccagttcctaaaggaaagccactgctcttgtagaagaaattagaaacagaaaggatgtgaaggtgtttaatgtcaccaaggaaaacagaaacca

SEQ ID NO: 57623 - DNA, 400 bp, Homo sapiens
  misc_feature 2, 22, 327, 339: n = A,T,C or G
tncattaacaggagaaatgcanataccttcatatcttctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttatatacaatgcttctttcctgnatattctcttgnctggctgcacccctttttcccgccccagattgataaagtaatgaaagtgcactgcagtgag

SEQ ID NO: 57624 - DNA, 333 bp, Homo sapiens
caaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattggtttttaaaatcagtactttttaatggaaacaacttgaccaaaaatttgtcacagaattttgagacccattaaaaaagttaaatg

SEQ ID NO: 57625 - DNA, 118 bp, Homo sapiens
cctaaatgtaagagagactgatggggaaagtatgatgggttttatttttatatcaaatcatcaggcatggagaaatatcttttagaagtgttaaaataaatgttcctactgtatattt

SEQ ID NO: 57626 - DNA, 400 bp, Homo sapiens
  misc_feature 3, 18, 41: n = A,T,C or G
tanaagcattcatatttntaccatttaatgttatgataatnttcataagctttagcataggcagcccatttaattggcactattgaatgtcagcacaggcataaaaatgcaggtgagtttcttttattaaaagtgccccaaacagagtcacacgtcaaatgtaataacaatctcatatttctgacttacttgcttatgattgtccataagccagtaataggttattcaaagtcattaaaataaattgatttgaaaaattacattcagtaaaaatgcatgtagaaagcaacatttaattcagagtaataagtatttttgttttgttacacataatgaatgcatctaagtaaattcctacagggtcttattaaatattttcagtgatgattgctagatgctt

SEQ ID NO: 57627 - DNA, 400 bp, Homo sapiens
actgcatgtgtgtgggggtgggggggcagggaagatcagaaaactggaaatgtaattctgataacacgcaaagtaaattgtgcattaaaagtatgggaattcttggtagcttaaagcttcaggggttaacttcagtgtatgaacacctagtgtgttagaattgcagtgcatagttgtttaaatacaatattccttgtaagtgacaaccaaaatatgttgtggctggtgccagtatttttgttaatgaaatgttcagtgtctcactacagtctgatcagaactcttggtgttataagccaggcctaaagccattttatagctattggcctaattgtgtaactttttctttcaaaatgtttattataatacttctgcattctttcacttaatatgcaattgc

SEQ ID NO: 57628 - DNA, 400 bp, Homo sapiens
  misc_feature 41, 43: n = A,T,C or G
tcctgtctctggatccaaatcagagggccttctctacgtcntntcatccagaggtggcccctttcagaggtggcaccttgacgaggtctttttagagctcaaggatggtcagcagattcctgtgttcaagctcagtggggaaaacggtgatgaagtgaaaaaggagtagagacgacccagaagacccagcttgcttctagtccatccttccctcatctctaccatatggccactggggtggtggccatctcagtgacagacactcctgcaacccggttttccagccaccagtgggatgatggtatgtgccagcacatggtaattttggtgtaattctaacttgggcacaacgaatgctatttgcatttttaaactgaatccgaaagaaactcctattata

SEQ ID NO: 57629 - DNA, 397 bp, Homo sapiens
  misc_feature 2, 9, 39, 41, 42, 73: n = A,T,C or G
gnggtggcnggcaggaggctttggcagctcgggactgantnnaagaatcagcatgattcttcagaggctcttnaggttctcctctgtcattcggtcagccgtctcagtccatttgcggaggaacattggtgttacagcagtggcatttaataaggaacttgatcctatacagaaactctttgtggacaagattagagaatacaaatctaagcgacagacatctggaggacctgttgatgctagttcagagtatcagcaagagctggagagggagctttttaagctcaagcaaatgtttggtaatgcagacatgaatacatttcccaccttcaaatttgaagatcccaaatttgaagtcatcgaaaaaccccaggcctgaagaaataaagtaaaatta

SEQ ID NO: 57630 - DNA, 396 bp, Homo sapiens
  misc_feature 42: n = A,T,C or G
aagagaaaatatgaagacttagaagagtagcatgaggatttnaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatggaaagattaattgggagtggtaggatg

SEQ ID NO: 57631 - DNA, 398 bp, Homo sapiens
  misc_feature 41, 43: n = A,T,C or G
aaattcacctacacagttctggaggatggttgcacgaaacntnctggggaatggagcaaaacagtctttgaatatcgaacacgcaaggctgtgagactacctattgtagatattgcaccctatgacatcggtggtcctgatcaagaatttggtgtggaccgttggccctgtttgctttttataaaccaaactctatctgaaatcccaacaaaaaaaatttaactccatatgtgttcctcttgttctaatcttgcaaccagtgcaagtgaccgacaaaattccagttatttatttccaaaatgtttggaaacagtataatttgacaaagaaaaatgatcttctctttttttgctggtccaccaaatacaattcaaatgcttttggtttatttttttacc

SEQ ID NO: 57632 - DNA, 400 bp, Homo sapiens
  misc_feature 13, 16, 35, 48, 51: n = A,T,C or G
tgagcccagaggntantgggcaagtttggatgcancaactcaaaccanttngtgaactcaccattccaaataacttaattggctgcataatcgggcgccaaggcgccaacattaatgagatccgccagatgtccggggcccagatcaaaattgccaacccagtggaaggctcctctggtaggcaggttactatcactggctctgctgccagtattagtctggcccagtatctaatcaatgccaggctttcctctgagaagggcatggggtgcagctagaacagtgtaggttccctcaataacccctttctgctgttctcccatgatccaactgtgtaatttctggcagtgattccaggttttaaataatttgtaagtgtcaagtttctacacaactttat

SEQ ID NO: 57633 - DNA, 100 bp, Homo sapiens
  misc_feature 22, 28, 32, 33, 34, 36, 38, 43, 44, 45, 46, 47, 49, 53, 62,64, 65, 68, 73, 81, 82, 83, 85, 93, 94, 95: n = A,T,C or G
gacttgggccgcaggccggccnacatgnatannngnanccttnnnnncntttncgggggggncnnttnggggnccccccgnnncnacccccannnggggg

SEQ ID NO: 57634 - DNA, 399 bp, Homo sapiens
  misc_feature 15, 286, 290, 306: n = A,T,C or G
caatgagtttgactncatctcatttctcgaatgaggaagctcgcccgggaaggagagaatcccccagatggcttcatggcccccaaagcatggaaggtcctgacagattattacaggtccctggagaagaactaagcctttggctccagagtttctttctgaagtgctctttgattaccttttctatttttatgattagatgctttgtattaaattgcttctcaatgatgcattttaatcttttataatgaagtaaaagttgtgtctataattaaaaaaaaatatntatntatacacacacacatnttcatacaaagtcaaactgaagaccaaatcttagcaggtaaaagcaatattcttatacatttcataataaaattagctctatgtattttctac

SEQ ID NO: 57635 - DNA, 386 bp, Homo sapiens
  misc_feature 40, 42: n = A,T,C or G
gacatgggacttcagcatggccggtgtttgcagatttggntntgcgagcgggttctgacctgaaggctctgcgcggacttgtggagacagccgctcaccttggctattcagttgttgctatcaatcatatcgttgactttaaggaaaagaaacaggaaattgaaaaaccagtagctgtttctgaactcttcacaactttgccaattgtacagggaaaatcaagaccaattaaaattttaactagattaacaattattgtctcggatccatctcactgcaatgttttgagagcaacttcttcaagggcccggctctatgatgttgttgcagtttttccaaagacagaaaagctttttcatattgcttgccacatttagatgtggatt

SEQ ID NO: 57636 - DNA, 253 bp, Homo sapiens
  misc_feature 1, 38, 39: n = A,T,C or G
nttgtgctttttcaggcttaatgtggtaaaaccatctnntgaaaaacatccctgggcaagcccaaggagcagtcattactgcttctggggccaatgggtttaatttctgagcacttcaccatgaccattctgttaacatgactgtcttccaagagaaaggacatgacttatagcatactgatttgtaagctaggacaagagcacaggaggcaaggaatattttcccccaatttgaaaatatttaacttttctg

SEQ ID NO: 57637 - DNA, 378 bp, Homo sapiens
  misc_feature 41, 43: n = A,T,C or G
caaggcatctgtgagcccgcggagtatacaccatgagcaantntcaccctcccgagttgaaaaaatttatggacaagaagttatcattgaaattaaatggtggcagacatgtccaaggaatattgcggggatttgatccctttatgaaccttgtgatagatgaatgtgtggagatggcgactagtggacaacagaacaatattggaatggtggtaatacgaggaaatagtatcatcatgttagaagccttggaacgagtataaataatggctgtcagcagagaaacccatgtcctctctccatagggcctgttttactatgatgtaaaaattaggtcatgtcattttcatattagactttttgttaaataaacttttg

SEQ ID NO: 57638 - DNA, 400 bp, Homo sapiens
  misc_feature 399: n = A,T,C or G
tgtttatacacaactttgcaaattatttattacttgtgcacttagtagtttttacaaaactgctttgtgcatatgttaaagcttatttttatgtggtcttatgattttattacagaaatgtttttaacactatactctaaaatggacattttcttttattatcagttaaaatcacattttaagtgcttcacatttgtatgtgtgtagactgtaactttttttcagttcatatgcagaacgtatttagccattacccacgtgacaccaccgaatatattactgatttagaagcaaagatttcagtagaattttagtcctgaacgctacggggaaaatgcattttcttcagaattatccattacgtgcatttaaactctggcagaaaaaaataactatttng

SEQ ID NO: 57639 - DNA, 354 bp, Homo sapiens
  misc_feature 41: n = A,T,C or G
ataaggaaagaactaaatgaatttaaaagcacagaaatggnttttcatgaagagagtcgacagtttacaaggtttcatcgtccataacgaagagtgagactatttggaaacagagactgatcatctttgggggaagccctgcttcctgaaaacctgatattgcactgggatttgaatgtgtgtgtttccgtttaacttgtggtgaaggaagtgtgtgactcagcttggctgggaagtgctcctcacctgtgtggcccagatggctccaacaagcaaaaggaaggatgcagtgactcttgctgccagaatgcacagcgatggtaagagacaccgtggatattcttcatcagaagc

SEQ ID NO: 57640 - DNA, 327 bp, Homo sapiens
gttaaacacttaaatgcagctattttgagttgagatgtgctgtaagtataaaatgcacaatgaatagtgaagacactggaatgaagaaagacaaaataacttaatgtgtcccagttgattatagtgttagtgatatttgggatatattaggttaaatattattgtaatgaattttataatcattaaaatggagtaattgagaaaagcccgttccttattaaccaaaaggtaagatggccattgttaggcattttaaagccccataaactcaacagtgattgaaaaactccagaggggcatgtagctttttacccacctgagcatagc

SEQ ID NO: 57641 - DNA, 398 bp, Homo sapiens
gtgttttgagcagaatgagtgttcagcttgggaactttggaatgtaataattagtaattggtaatgtccatttaatataagattcaaaaatccctacatttggaatacttgaactctattaataatggtagtattatatatacaagcaaatatctattctcaagtggtaagtccactgacttattttatgacaagaaatttcaacggaattttgccaaactattgatacataagggttgagagaaacaagcatctattgcagtttctttttgcgtcaaatgatcttacataaatctcatgcttgccattcctttcttcataacaaaaaagtaaagatattcgggtatttaacactttgttatcaagcacattttaaaaaggaactgtctgtaaatgga

SEQ ID NO: 57642 - DNA, 190 bp, Homo sapiens
agatgtgacgttggaactgctctggcacttctgtcaagcctcccccgccccaattgccttgagatctctgctctttgtcagagatttgcaaagactcacgtttttgttgttttctcatcattccattgtgatactaagaaactaagaagcttaatgaaaagaaataaaatgcctatgttgttgttctaga

SEQ ID NO: 57643 - DNA, 205 bp, Homo sapiens
  misc_feature 4, 12, 35: n = A,T,C or G
cgtnttgggttnttctcttccttcgctaacgcttnccggctctcgtcagcctcccgccggccgtctccttaacaccgaacaccatgccttcaattaagttgcagagttctgatggagagatatttgaagttgatgtggaaattgccaaacaatctgtgactattaagaccatgttggaagatttgggaatggatgatgaaggaga

SEQ ID NO: 57644 - DNA, 397 bp, Homo sapiens
  misc_feature 1, 10, 378, 395: n = A,T,C or G
naatatgccnaggcgtaatgaaaaccatcccgtccccattcctcctcctctttgagggactggagggaagccgtgcttctgaggaacaactctaattagtacacttgtgtttgtagatttacactttgtattatgtattaacatggcgtgtttatttttgtatttttctctggttgggagtatgatatgaaggatcaagatcctcaactcacacatgtagacaaacattagctctttactctttcccaaccccttatatgattttaataattctcacttaactaattttgtaagcctgagatcaataagaaatgttcaggagagaggaaagaaaaaaaatatatgtatatataacctttattattgctatatctttgnggataatacattcaggngg

SEQ ID NO: 57645 - DNA, 375 bp, Homo sapiens
  misc_feature 1, 51, 54: n = A,T,C or G
naatatacccccgcaagggaaagatgaaaaattataaccaagcataatatnttnaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagag

SEQ ID NO: 57646 - DNA, 400 bp, Homo sapiens
  misc_feature 43, 346, 390: n = A,T,C or G
tcattttgacattatcaataggagaaaagaaaactaacccttnttctgattgtttggagccatagttgtctcagatgttctaattctctttgtatgcttggaaacagcatagatatgttgctgtggttttcagaattttctcttttaatcacaagaagccttttaaaaaatgacttacacatattctcaatgtacagtaaaacagacagaagtgagcttatctgtttgatgctgtggcagggtcccagtcactgggcatatcctccttctccttaaccagctcctcagcagcccctgagtcacctgcacaggggcttgggaactgctggttatgagcattcctggntttcttcagccaaataacaggtaatcactgcaattggatttggnctgcattatt

SEQ ID NO: 57647 - DNA, 201 bp, Homo sapiens
  misc_feature 3, 18: n = A,T,C or G
atntgtgcaagccatatnggatggaagtttacggccaccaaaaaagacatgtcacctcaaaaattttggggcttaacgcgatctgctctgttgcccacgatcccagacactgaagatgaaataagtccagacaaagtaatactttgcttgtaaacagatgtgatagagataaagttagttatctaacaaattggttatatt

SEQ ID NO: 57648 - DNA, 261 bp, Homo sapiens
  misc_feature 9, 11, 200: n = A,T,C or G
gctgaagangnttttcgaggctcaggagaagctctacaaggaatatctgcagatggcccagaatggaagcttccagtgagggggcacaggactgactttttaaaccattgtggactagtggctgctgtctgcctcagtgacaatgtcccagcgctcctatcatgtttacagtcacccttgggtcctaaattaggagttgngttcatgtaggttcgtgtcgtcgttggctctgagacattgataataaatttttctcaacag

SEQ ID NO: 57649 - DNA, 400 bp, Homo sapiens
  misc_feature 43, 93, 97, 126, 278: n = A,T,C or G
acagaacaaaaagccttccccagaaaaatgtctttctttgttnaaacacccaaggagactttaactgggaaataaaataacctctaaggactntgtnatatttagagaggcctctttggcctttgnatattttattccacttcattgccaacacccctaactttttaatagaggacatccctttgtatctgcctttatatttatagtcaaaatcaaattcccttctcactctggattttaaatttcatggactggacagtaaacttttaatggattgngatatcagagaaagagaattttaggtatgaaagtttcctcaggaaacgaccacatgaaacccactggttaaatctgaggactggcacttggtaagcaggcatggagaattcgggtagggtcg

SEQ ID NO: 57650 - DNA, 249 bp, Homo sapiens
  misc_feature 6, 17, 32, 34, 41, 42, 45, 55: n = A,T,C or G
tgtgcngtcgttcgttntgctcggtgggagtntnttagganncgntcacattggnagagataaaaaaaaacacctcgacatttaaaaaatcaaccaacacaagatcaaaaaggaaaaggacgagagaaaaattatttttaagataattaaacataaaaccctggtgcttcttacattataaagtacgttttaaagaacccacaaactattatacataagtttatgaatcaattaaatatcctgcacttg

SEQ ID NO: 57651 - DNA, 140 bp, Homo sapiens
  misc_feature 22, 31, 43, 51, 55, 60, 133: n = A,T,C or G
cggaaaataatgcacatatggngttcaaatntgaacctttctnatggattnttgnggtgngggccaatatggtgtttacattatataattcctgctggggcaagtaaagcacactttttttttctcctaaaangtttttc

SEQ ID NO: 57652 - DNA, 232 bp, Homo sapiens
  misc_feature 8, 15, 28, 37, 39, 41, 42, 58: n = A,T,C or G
atttagtnaagcttntcttttttaattnccaggaaanantnnaaagagtatgagtctnctgtaattcattgagcagttagctcatttgagataaagtcaaatgccaaacactagctctgtattaatccccatcattactggtaaagcctcatttgaatgtgtgaattcaatacaggctatgtaaaatttttactaatgtcattattttgaaaaaataaatttaaaaatacga

SEQ ID NO: 57653 - DNA, 191 bp, Homo sapiens
gtatacaggaagagaaatggatccagaaatagacattatgtgcacaggaccagaagcgggaaacactgaggaaaaatccgcagaggaagtaacaatgagtcccgcaattgccatcatgcagccaatactgagatttcttcagttactgtgtgagaatcacaaccgggaattgcagaacttcttgaggaatc

SEQ ID NO: 57654 - DNA, 197 bp, Homo sapiens
  misc_feature 5: n = A,T,C or G
aacgnctataagaaggagaaagctcgagtcatcactgaggaagagaagaatttcaaagccttcgctagtctccgtatggcccgtgccaacgcccggctcttcggcatacgggcaaaaagagccaaggaagccgcagaacaggatgttgaaaagaaaaaataaagccctcctggggacttggaatcagtcggcagtca

SEQ ID NO: 57655 - DNA, 397 bp, Homo sapiens
  misc_feature 11, 13, 28, 39, 47, 49, 58, 59, 61, 65, 248, 333: n = A,T,C or G
agtaatatcantntttgccatattgaanattaaatttgntttaaatntnaaaatattnntnaatntaggaaataagcttattatatattaacagaaatatttaaactaaaaaaaatattttccaaaacaaaaagtttaatgaaaagactggcattgttttacttttgcaaatttaatgagtttggcttaatagaagatagctgaattttatatctatttttaccttcaatctgttatgttttgttggntttagtatatgaagaatatctaaccatatacagatatgtaagtggaaaagcagaaagtattttaatagctttttcagggaattgnagatattcttctttgatctacgccagaacttgataaatggtagtttcttagagggtaggttgtt

SEQ ID NO: 57656 - DNA, 400 bp, Homo sapiens
  misc_feature 4, 15, 292: n = A,T,C or G
attncaacttatagnttgctatgatttttatatataaatattatataaataatgtataaaacattaaaagttaactatgtaagatattatttctgaaacaatttagctatatccactatgattataaactgttctcgcctgtgttatttacattagctgcttaaaaaagcattgagttaatttttttaaatatcaactaaaatatcatagttctgtggtaagacattgttttataatgaaataactgcactagagaaaactgtataaaaacattaaattgcagtatttttgnaagggtccattttgtaaagagaataatattcaaagcttttgtagcatacaaagtgaaaacttgtatctgcgaaactatacttgtattaaatgtgcttttaaataaaag

SEQ ID NO: 57657 - DNA, 400 bp, Homo sapiens
  misc_feature 14, 22, 27, 28, 38, 40, 44, 47: n = A,T,C or G
gacgtaaggagaangttgaaangcccnnagatccaaanantttnttngagcaccacgcaagaagatccatcgcagagtcctaaagaagaacccactgaaaaacttgagaatcatgttgaagctaaacccatatgcaaagaccatgcgccggaacaccattcttcgccaggccaggaatcacaagctccgggtggataaggcagctgctgcagcagcggcactacaagccaaatcagatgagaaggcggcggttgcaggcaagaagcctgtggtaggtaagaaaggaaagaaggctgctgttggtgttaagaagcagaagaagcctctggtgggaaaaaaggcagcagctaccaagaaaccagcccctgaaaagaagcctgcagagaagaaacctactaca

SEQ ID NO: 57658 - DNA, 397 bp, Homo sapiens
  misc_feature 6, 14: n = A,T,C or G
aacccngagaaggncattgcggctcatatcaagaaggaatttgacattaagtacaatcccacctggcattgcatcgtggggaggaacttcggtagttatgtgacacatgaaaccaaacacttcatctacttctacctgggccaagtggccattcttctgttcaaatctggttaaaagcatggactgtgccacacacccggtgatccatccaaaaacaaggactgcagcctaaattccaaataccagagactgaaattttcagccttgctaagggaacatctcgatgtttgaacctttgttgtgttttgtacagggcattctctgtctagtttgcgtggttataaaacaattagcagaatagcctacatttgtatttattttctattccatacttctg

SEQ ID NO: 57659 - DNA, 261 bp, Homo sapiens
  misc_feature 2, 34, 50: n = A,T,C or G
anggcatcaagtctcaggaaatggtgcatttggngaacattgagtccgtnagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactcta

SEQ ID NO: 57660 - DNA, 100 bp, Homo sapiens
  misc_feature 2, 13, 27, 45, 56, 57, 87, 90, 91: n = A,T,C or G
gngaccgacaagnaagtaagggaattnccacttaatcttcccaanagatagagaanngtgacttttagacagtggtggggtataggngcnntgaattctg

SEQ ID NO: 57661 - DNA, 122 bp, Homo sapiens
  misc_feature 10, 15: n = A,T,C or G
gatacttctngcttntcatgatgcatgtttctgtatgttaatgacttgttgggtagctattaaggtactagagttgataaatgtgtacagggtccttttgcaataaaactggttatgacttg

SEQ ID NO: 57662 - DNA, 236 bp, Homo sapiens
agaggcaggaggatcatttgagtccaggagttcaagattagactgagcaacacggggagacctcatctctacaaaaaaatttaaaagaaaattaattgggcatcatggcacgagcctgtgggttcccgctactcgggaggctgaggtgggaggatcacctgagcccaggaggttgagactttgcagtgagctgagtcacaccactgcctcgaaccttgatgacagaatgagactgt

SEQ ID NO: 57663 - DNA, 397 bp, Homo sapiens
  misc_feature 11, 19, 30, 36, 37, 39, 48, 49, 59, 67, 74, 78: n = A,T,C or G
aataagcccancaaagggnactactttganacggcnntngtgaattcnntttttgatanagcctatnaggaatngctnaggttaattaacaaacttgatactgaacctcagtgggtaccatccacttggctgaggtgaaagaaacatccattctgtggcatgttggacttgatctggcaaaaactgccaataggaggactgcccgacactgcagcaagattgaggataagatggaaggcagcagtataagctgtagatctgttcttagatctcttgaattagtgagacgacagttcccttaggcagtttgtgcatggcatcctttattctctatacatggctttagcggtcttgcctcattttgggattctaaatggaagcttcaacagagcatcca

SEQ ID NO: 57664 - DNA, 212 bp, Homo sapiens
  misc_feature 32: n = A,T,C or G
tcagatcccatccaacacacggtttaattttnatggggctcttgggatcaaaagaacagaaacagcaacaacaaaagcccagccgcttgtctgattttaagctggcaaagtgggaaaaataaagtgttgagtaaacagaccaagttggatcatggggaatttcagaggtcatgccctccctggaaccttcttttttattattggctttgggg

SEQ ID NO: 57665 - DNA, 205 bp, Homo sapiens
  misc_feature 42, 44, 56: n = A,T,C or G
atatattatataataggtccttccactttttggagagtagcntnatctagcttttntgtacagacttagaaattatctaaagatttcatctttttacctcatatttcttaggaatttaatggttatatgttgctttttttcctatgtcttttggctcaagcaacatgtatatcagtgttgactttttctttcttagatctagttt

SEQ ID NO: 57666 - DNA, 242 bp, Homo sapiens
  misc_feature 18: n = A,T,C or G
ccacttgctgaaaaggtnaaggccttcttggctgatccatctgcctttgtggctgctgcccctgtggctgctgccaccacagctgctcctgctgctgctgcagccccagctaaggttgaagccaaggaagagtcggaggagtcggacgaggatatgggatttggtctctttgactaatcaccaaaaagcaaccaacttagccagttttatttgcaaaacaaggaaataaaggcttacttctc

SEQ ID NO: 57667 - DNA, 169 bp, Homo sapiens
  misc_feature 10: n = A,T,C or G
tacatgaagnttcatgcacttaaagaagtatttttagaataagaatttgcatacttacctagtgaaacttttctagaattatttttcactctaagtcatgtatgtttctctttgattatttgcatgttatgtttaataagctactagcaaaataaaacatagcaaatgg

SEQ ID NO: 57668 - DNA, 400 bp, Homo sapiens
  misc_feature 42, 282, 340, 341, 369: n = A,T,C or G
gtagagataaagacactttttcaaaaatggcaatggtatcangaattcctcaagcaggcctggtttattgaaaatgaagagcaggaatatgttcaaactgtgaagtcatccaaaggtggtcccggatcagcggtgagcccctatcctaccttcaatccatcctcggatgtcgctgccttgcataaggccataatggttaaaggtgtggatgaagcaaccatcattgacattctaactaagcgaaacaatgcacagcgtcaacagatcaaagcagcatatctncaggaaacaggaaagcccctggatgaaacactgaagaaagccctacaggtcaccttgnngaggttggtttagctctgctaaaaactncagcgcaatttgatgctgatgaacttcgtgc

SEQ ID NO: 57669 - DNA, 245 bp, Homo sapiens
  misc_feature 10, 11, 222, 225: n = A,T,C or G
actagaatanngctgaatgagtcagatttttgggctagtagatggcaaaattcttccatatgctatgtttaagacaaatacctaaaaccaaaagaaataattgttgaaaatatggaaattttacattttaagtaggaaattaagaatttcctatttaaaattttagatgagaaatttttaaagaggaaaatgatatagcaggaaaatgtaaataatatcagnggnagttaatatcagatagggtg

SEQ ID NO: 57670 - DNA, 396 bp, Homo sapiens
  misc_feature 2, 20, 51: n = A,T,C or G
cnggagaccaatagcagacntctcagtggaaaccctacaagccagaagatnttgggggtcaatattcagcattcttaaagaattctttgccagaatttagtatctggccaaagtaagctttatgtgcaaagaaataagatccttttcagacaagcaaatgctgagagaattcatcaccaccaggccttccttgcaagagttcctgaaggaagcactaaatatggaaagaaaaaaccattaccagccactacaaaaacacactgaagtacatagaccaatgacactataaagcaaccacataaacaagtctgcaaaataaccagctagcatcatgatggcaggatcaaattcacacataacaatactaatatcaaatgtaaataggctaaatgcccc

SEQ ID NO: 57671 - DNA, 400 bp, Homo sapiens
  misc_feature 18, 19, 29, 41: n = A,T,C or G
caatttgcatgagggatnnttcacactanagagaacttttntaatgaaagagcacggtgtgtatccctctgaatttaattggcagagtttaaagaaaattaaagcataggaattgtgctgtctgtctttgactgcattttatatacttagagctccatgccagtggaaaagatatttgaagatcaacagttggggctttcaggatgttgtaataaaagacttaacactgatatattaaatccttgggttgtattgatgtaggtagaggactgtattcaagaaatgtctgctctgatttccatcatagttaaagctgtgccacaacatttcaatggtaaaggcagaagccttagccagaactaaaacaatgtagatgtgcatgctaaaagggtaataaagg

SEQ ID NO: 57672 - DNA, 207 bp, Homo sapiens
  misc_feature 17, 32, 37, 45: n = A,T,C or G
cgcgagaccaggctggncaaccgtggtgaaancttgnctctattnaaaatacaaaaaattaagggggcatggtggtgcatacctgtaatcccagctactcgggaggctgaggcatgagaatcacttgaacctgggaggcaagaggttgcaatgagccaaggtcctgccactgcactccagccttggggacagagtgagactctgtgg

SEQ ID NO: 57673 - DNA, 400 bp, Homo sapiens
  misc_feature 3, 16, 50, 67, 90, 92: n = A,T,C or G
gcncttgcggaaggcnaggctggagtgctatttttgatgcagcacgtggnggatacacgagattgtntgtttcagtttccccatttgtgngngcttcaaatgatccttcctactttgcttctctccacccatgacctttttcactgtggccatcaggactttccctgacagctgtgtactcttaggctaagagatgtgactacagcctgcccctgactgtgttgtcccagggctgatgctgtacaggtacaggctggagattttcacataggttaagattctcattcacgggactagttagctttaagcaccctagaggactagggtaatctgacttctcacttcctaaagtcccttctatatcctcaagggagaaatgtctatgttttctactccaatt

SEQ ID NO: 57674 - DNA, 136 bp, Homo sapiens
  misc_feature 13, 39: n = A,T,C or G
tctacaaggttanccagcatgctgttggcattgttgtanacaaacaagttaagggcaagattcttgccaagagaattaatgtgcgtattgagcacattaagcactctaagagccgagatagcttcctgaaacgtgt

SEQ ID NO: 57675 - DNA, 348 bp, Homo sapiens
  misc_feature 2, 27, 33, 49, 333, 346: n = A,T,C or G
angcacgtcatggatcaggtaatgcantttgtngagccaagtcggcagnttgtaaaggactccattcggctggttaaaagatgcactaaacctgatagaaaagaattccagaagattgccatggcaacagcaataggatttgctataatgggattcattggcttctttgtgaaattgatccatattcctattaataacatcattgttggtggctgaatacattttggaagagagtttttcatcttagagattggtgaacaagtgtgagggtgtgagaaactcacagaatacaaatttacctgtatgttttgtgggtttttttttttttccttncaagatgtttctntt

SEQ ID NO: 57676 - DNA, 282 bp, Homo sapiens
  misc_feature 8, 39, 166, 169, 194, 210: n = A,T,C or G
actgcctnatataaaaatcatatatatggtaataatttntttcttttgtagtctgcacaagagccataaaagattgtatttttattactatttaaacaagtgattaaaattagtctgcacagtgagcaaggggtcacatgcattcttttatactgctggattttgntgngcatcatttaagacattttggatgnttcttcttatctgggnatacaggatggtcttgaatgatggtcatttgtcaggagaactgtgagaaataaactatgtgggtactggctg

SEQ ID NO: 57677 - DNA, 400 bp, Homo sapiens
  misc_feature 10: n = A,T,C or G
aacattattnccaccataaagtatgtattgaaatcaagttgtttctgtggcagaatacatacttattcccatttttaagcatttgcttctgttttccctacctagaatgtcaagatgtttttcagttatctccccatttgtcaaagttgacctcaagataacatttttcattaaagcatctgagatctaagaacacaattattattctaacaatgattattagctcattcacttattttgataactaatgatcacagctattatactactttctcgttattttgtgtgcatgcctcatttccctgacttaaacctcactgagagcgcaaaatgcagctttatactttttactttcaattgcctagcacaatagtgagacatttgaattgggtatataata

SEQ ID NO: 57678 - DNA, 139 bp, Homo sapiens
  misc_feature 3, 9, 78, 83, 97, 137: n = A,T,C or G
ccngagaanaaccactggattccagcctaggatacataagtaagaccccatctctttaaaaaaaaaaagaaaagaganttaangaccaacgttcctnatgaaaatagaggcataattccttaacaaaatgttagctngc

SEQ ID NO: 57679 - DNA, 395 bp, Homo sapiens
  misc_feature 15, 19, 25, 32, 37, 38, 39, 48, 51, 52, 58, 306, 384: n = A,T,C or G
aatggccccaacggncatnaattcnagggacnactgnnngagagaggnatnnggcccngagcgaggaaaggattttaccaaagcatcaatacaaccagcccaaccatcggtccacacctggcatttggtgagagtcaaagctgaccatggatccctggggccaacggcaacagcatgggcctcacctcctctgtgatttctttctttgcaccaaagacatcaagtctccaacatgtttctgttttggtgtttgattcagcaaaaatctccagtgacaacatcgcaatagttttttacttctcttangtggctctgggaatgggagaggggtaggatgacaggggtagtttgttttagaaccagccgtattttacatgaagctgnataattaattg

SEQ ID NO: 57680 - DNA, 110 bp, Homo sapiens
  misc_feature 4, 13, 42: n = A,T,C or G
cccnaaacttttncttatttccttccaattgattcaaatgcnagtacaagttcttccttacaaatttccaatgctgaatctagttgcctaacctaagcaggaaaaaaagc

SEQ ID NO: 57681 - DNA, 181 bp, Homo sapiens
  misc_feature 22, 38, 40: n = A,T,C or G
ctcctctggaagggaagctcantcaggaaaaccaagtncnagaagaaagaaaggaatagaactgggagacattcagagttccatcgaatctataaaacaaacacaggaagaaattaaaagaaatattatggctcttcgaaatcatttagtttcaagcacaccggccacggattattttctg

SEQ ID NO: 57682 - DNA, 238 bp, Homo sapiens
  misc_feature 3, 17, 31: n = A,T,C or G
agnttgaggaaaccgcngataagtgtttttntctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatgggg

SEQ ID NO: 57683 - DNA, 188 bp, Homo sapiens
  misc_feature 16, 18, 37, 152, 172: n = A,T,C or G
cttcttgatgcctggntntgataaaaggtaattcatngccaaattaattcatatttgtatttattaatcactgtgacaacattaaccatttgttcttaccaggaagtggtcagattatcatctgagttacagttagactggctaagtttggnattaagatcaaggggaatgnccagtaaacagagagg

SEQ ID NO: 57684 - DNA, 397 bp, Homo sapiens
  misc_feature 3, 10, 396: n = A,T,C or G
cangaacccncacatgaaaaactgctcatcatcactggccatcagagaaattcaaatcaaaaccacaatgagataccatatcacactagttagaatggtgatcattaaaaagtcaggaaacaacaggtgctggagaggatgtggagaaataggaacacttttacactgttggttggactgtaaactagttcaaccattgtagaagacagtatggcgattcctcaaggatctagaactagaaataccatttgacccagccatctcattactgggtatgtacccaaaggattataaacacatgcacatgtatgtttattgcagcactagtcacaatagcaaagatttggaaccatcccaaatgtccatcaatgatagactggattaagaaaatgtggnc

SEQ ID NO: 57685 - DNA, 384 bp, Homo sapiens
  misc_feature 1, 3, 51, 376: n = A,T,C or G
nantatacccacattcattcattcaacaatatttattgacctcttgtattntaggcatgccctagctgagttataagggtgaatcatagaggtgagatttcattcctaaaggagtgaatatctaaagaagggaagacaacaataaataacattaacaaagcaacaggttggtttgtgtttccttggaaagatggctcttttggtgctgacttcttagataacagaagcttcagactaggctctggggaaggatctgaaagcaatccctcttcctggacttggtggtttgtgcttgtagtcccagtgactcgggaggctgaggcagaaggatcacttgagcccagtagttttgagtccagtcttggcaacataacangacactgt

SEQ ID NO: 57686 - DNA, 372 bp, Homo sapiens
  misc_feature 9, 19: n = A,T,C or G
aatgaaccncagagttgtngaacataatattagaataatggccaagtattttactcggataacaatgaaaaggatggcacagcttctggatctatctgttgatgagtccgaagcctttctctcaaatctagtagttaacaagaccatctttgctaaagtagacagattagcaggaattatcaacttccagagacccaaggatccaaataatttattaaatgactggtctcagaaactgaactcattaatgtctctggttaacaaaactacgcatctcatagccaaagaggagatgatacataatctacaataagggtcttagtgctttagaaaaaaagttaaaattggaagtcattaaaaaaagactgtttt

SEQ ID NO: 57687 - DNA, 398 bp, Homo sapiens
agggctgtgaaagatttttgatagtgaatcatgaccctttgggagagatttgtgtgataaaagtattgtatataatagatcagcgatttttgtaaggcaaacagaatttgtaagttggcagatcttcctaagttgcaaaatgtaatgatgagcttggtggagaagaatgagtcgttcttggaatacctatgtgcagccactacccatctcaatgtcaccttgtttgcattcttggatagcttgtatatgtagtagtttgatgaataatttaaagaaaaacacctaaaatttgaaaaatgattgtaggatcaaaaaaggcagatgaaattacttaatctcagtgttttggagagtattccttttagttggtggttgctggtttgacggatagaaatatg

SEQ ID NO: 57688 - DNA, 397 bp, Homo sapiens
  misc_feature 6, 24, 28, 30, 35, 38, 42, 44, 61, 374: n = A,T,C or G
aataancccgctgtgttgatatcngtgnanagtangcntgcngncttgttctgtgacctangaacaaaactgtaactgcattagaaaccatgaaaaaattagatattgttttgtgacttttagacagtggtaaatatagaaccatgaattctggtcacattccatttctctccaacatgaaggatcaaaaaaatgtttttcaatgtgttctttgttccactggaaacttagagtcatgagtttatgagctgatttggtcaccttcctctgcctttgtcactgtgagttctgatgcttagtgacttagtcttagaagctcacgccttagtttgaaacagattctccacggtggccccaaaacactgctgcatatncataagaattgagcgctatgggt

SEQ ID NO: 57689 - DNA, 398 bp, Homo sapiens
  misc_feature 340: n = A,T,C or G
atttagtatgctccgtagagacagttcagccagtcatttttgcattggagagacttctcattttctttgaagactcatagaaagctggatctagagcttttgaatccttaattagcacagtagaaattagctttctatgggaatgctttagtgttagcagttgacaattaggcccatattcaatctgaatgggaacaaaagtaaatgcagtgataatatactgctagttagagaaacatgttagttgattatacctgaaatggattatttatctcatcagcaagtattatttgaataaaatgagaaatgcttaagaaaaattggtgctctatagtaattnggttcgaagaatggaatggtaactattttttcccatcgtcttttgagagaaggaagtg

SEQ ID NO: 57690 - DNA, 288 bp, Homo sapiens
  misc_feature 14, 15: n = A,T,C or G
tgaatttcatgagnntaccatgctgtgtttgttatgcggcaaagccgaagatactatcagtattctccctgatgacccccgacaaatgactctcttattctaaggatccttctacagatctgttataactatattgtgttggtttacaatacagcaagcctgatggtttgtcttatttcattcatactgaaaattctttgcatattttttttctgcttagacttacttattctttgaggaaaaaaggtaatgtaggagctcattgttctctagagctgagctcttctg

SEQ ID NO: 57691 - DNA, 234 bp, Homo sapiens
  misc_feature 2, 17, 208: n = A,T,C or G
tntcccttgaccatttncgacggcatctacggctcaacattttttgtagccacaggcttccacggacttcacgtcattattggctcaactttcctcactatctgcttcatccgccaactaatatttcactttacatccaaacatcactttggcttcgaagccgccgcctgatactggcattttgtagatgtggtttgactatttctgnatgtctccatctattgatgagggctt

SEQ ID NO: 57692 - DNA, 400 bp, Homo sapiens
  misc_feature 8, 9: n = A,T,C or G
aaaccggnngccgcttgcagcatggctgaccaactgactgaagagcagattgcagaattcaaagaagctttttcactatttgacaaagatggtgatggaactataacaacaaaggaattgggaactgtaatgagatctcttgggcagaatcccacagaagcagagttacaggacatgattaatgaagtagatgctgatggtaatggcacaattgacttccctgaatttctgacaatgatggcaagaaaaatgaaagacacagacggtgaagaagaaattagagaagcattccgtgtgcttgataaggatggcaatggctatattagtgctgcagaacttcgccatgtgatgacaaaccttggagagaagttaacagatgaagaagttgatgaaatgatca

SEQ ID NO: 57693 - DNA, 219 bp, Homo sapiens
  misc_feature 23: n = A,T,C or G
tctaatcgttgtcaaccagtgcnagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaacactctttttg

SEQ ID NO: 57694 - DNA, 399 bp, Homo sapiens
  misc_feature 21, 34, 191, 342, 349, 370: n = A,T,C or G
aaacaaatttgtttttatgtnctcttctcccttnccatctttcagcatagacttaactcccttaagcccagacatctgttgagacctgacccctagtcattggttaccagtgtgtcaggcaatctggactttccagtgatgccactgagatggcacctgtcaaaagagcagtggttccatttctagattgnggatcttcagataaattctgccattttcatttcacttcctgaaagtcagggcggcttgtgaaaagttggtaaacaacatgctaaatgtgaaatgtcaaccctcactctaaactttccctgttcagcgcatcagatgaagacttcattgggnttatagnggctttctgattttgggaagnccattgaagaagggagtttgaaagtggtg

SEQ ID NO: 57695 - DNA, 397 bp, Homo sapiens
  misc_feature 1, 3, 50, 51: n = A,T,C or G
nantggacccgtgaacatcttaatgactagcttcttacagtacatttctnntgaagtaaacccccccagcgatgaaacagattcatcctctgctccttccaaagaacagttagagcaggaaaaacaactactactatctttcaagccagtaatgcagaaatttcttcatgatcacgttgatctacaagtcagtgccctgtatgctctccaggtgcactgctataacagcaacttcccaaaaggcatgttacttcgcttttttgtgcacttctatgacatggaaattattgaagaagaagctttcttggcttggaaagaagatataacccaagagtttccgggaaaaggcaaggctttgtccaggtgaatcaagtggctacctggttagaaactgctg

SEQ ID NO: 57696 - DNA, 400 bp, Homo sapiens
  misc_feature 44, 52, 75, 281, 328, 370: n = A,T,C or G
ctcggaggtggccacttgcgcagaccagacttcgctcggacttntgcgcctngcttagcttttcctccgcaaccntgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgnttaactttgtaagatgcaaagaggttggatcaagtttaaatgactgngctgccctttcacatcaaagaactactgacaacgaaggccgngcctgcctttcccatctgtctatctatctg

SEQ ID NO: 57697 - DNA, 296 bp, Homo sapiens
  misc_feature 3, 37, 52: n = A,T,C or G
atntgagaagctggatgaatatatatatagacacttntttggtcacactttntcccctccatatggacccaggtcggtttacataaaaccgtgtcattacagtagtttgtaacatttgtagattggatagcatttttatgatttgatgagtttcttgtaaggttaccgtttctaagagttgtgctttatggccactgagagaattcagaataaattgaaagatggagctaaaaattattagctgttacaaatggaacatttcattataacgtgatcactttgacttgagcaaatgg

SEQ ID NO: 57698 - DNA, 399 bp, Homo sapiens
  misc_feature 2: n = A,T,C or G
angattccataggagccaactggctgggtcggggctcaataccccaagctttacctgcaactgaggattcttcccggggagaccgcagcccatcggcatggctcaagagtttgtgaactgcaaaatccagcctgggaaggtggttgtgttcatcaagcccacctgcccgtactgcaggagggcccaagagatcctcagtcaattgcccatcaaacaagggcttctggaatttgtcgatatcacagccaccaaccacactaacgagattcaagattatttgcaacagctcacgggagcaagaacggtgcctcgagtctttattggtaaagattgtataggcggatgcagtgatctagtctctttgcaacagaatggggaactgctgacgccggctaaagc

SEQ ID NO: 57699 - DNA, 391 bp, Homo sapiens
  misc_feature 4, 10, 28, 49, 53, 60, 62, 63, 64, 67, 68, 72, 73, 75, 80,85, 91, 127: n = A,T,C or G
atancaattngcatggagggattaattnacaactagtaggagaactgtngaangcggganannncgnngagnntncctgngtttnagtttnacttgatcatttagcccagaccacccaggatgtgtncccaaaatgttccacaggcgtgtcccgctggatccatttgtccttgtcacttggagaaaggccagtccctgtgacgggcagccctctctgtccctcggtcagctcgtgtgaatcctgggacctcttccggtcggctctgcccgctgttctggggtcgactgccacgacttttgattcaagaagcttctcaggcgggagcggctatttttcctaaatgagaattggtacattgcaaattggtgaataaaatattttgcgctcctt

SEQ ID NO: 57700 - DNA, 150 bp, Homo sapiens
aaagaagaccaaactgagtacttggaggaacgaagaataaaggagattgtgaagaaacattctcagtttattggatatcccattactctttttgtggagaaggaacgtgataaagaagtaagcgatgatgaggctgaagaaaaggaagac

SEQ ID NO: 57701 - DNA, 105 bp, Homo sapiens
  misc_feature 20, 43, 103: n = A,T,C or G
caactcggataaccattgtnagttaatcagactataggcattnatcacactataaataatccacctataacttctctgttaacccaacaccggaatgcctaangg

SEQ ID NO: 57702 - DNA, 362 bp, Homo sapiens
  misc_feature 3, 4, 44, 46, 289, 298, 320, 325: n = A,T,C or G
ccnngatgtgcaaaaccttttactggttgcatggaaatcagccntnttttataatccttaaatcttaatgttcctcaaagcttggattaaatacatatggatgttactctcttgcaccaaattatcttgatacattcaaatttgtctggttaaaaaataggtggtagatattgaggccaagaatattgcaaaatacatgaagcttcatgcacttaaagaagtatttttagaataagaatttgcatacttacctagtgaaacttttctagaattatttttcactctaagncatgtatgnttctctttgattatttgcatgntatgnttaataagctctagccaaataaaacatagccaatggc

SEQ ID NO: 57703 - DNA, 166 bp, Homo sapiens
  misc_feature 3, 8: n = A,T,C or G
gtnatgcncattgatagaggccagatgtgtcttggaagttccaaagttgcaacgatttctggctagtgccacgaggtttacttgactgttgtgtgaaaagctgataagaaaaccatccagaaaaaagctcttcgttttacaaacatgaaaataaaacatgtaattt

SEQ ID NO: 57704 - DNA, 276 bp, Homo sapiens
  misc_feature 43, 275: n = A,T,C or G
tgccatcccatgcaacaacaagggagctcactcagtgggtttnatgtggtggatgctggctcgggaagttctgcgcatgcgtggcaccatttcccgtgaacacccatgggaggtcatgcctgatctgtacttctacagagatcctgaagagattgaaaaagaagagcaggctgctgctgagaaggcagtgaccaaggaggaatttcagggtgaatggactgctcccgctcctgagttcactgctactcagcctgaggttgcagactggtctgaang

SEQ ID NO: 57705 - DNA, 288 bp, Homo sapiens
  misc_feature 16, 29, 31, 40, 44, 46, 67, 69, 70, 76, 79, 82, 92, 94, 95: n = A,T,C or G
gctcggcctgatatangaagcatatatanangaataaatncttnanggatgatgacattgagctagncnnaaattnagnggntttgattcancnngccacaacagttaaaaacaaggatatcaggaaatttttggatggtatctatgtctctgaaaaaggaactgttcagcaggctgatgaataagatctaagagttacctggctacagaaagaagatgccagatgacacttaagacctacttgtgatatttaaatgatgcaataaaagacctattgatttggaaaac

SEQ ID NO: 57706 - DNA, 395 bp, Homo sapiens
  misc_feature 2, 6, 37, 39, 61, 271, 333, 350: n = A,T,C or G
gnactntcaagacagcttctctaaggctggcatgttntntccttgctttgctttttgccgntttaaaatgtgtaattgttccagcattccaatggtcttgtgcatagcaggggactgtaaccaaaaataaacatgtatttgtgtaattggtttgaagaagtcttgaatagctctttactgtcttacttggggttgataagatttgagtgtttgcaattttttactaaatgtagctccaaagtcttaaatggcttgtttgttcttaaactgntaattgatgaaactgtgcataagtttacaatgtactaacttattttgcttattatatatagnggtttattggaaattgnaaccaccacttcagcatgatgaaaataaagataggggttccattt

SEQ ID NO: 57707 - DNA, 374 bp, Homo sapiens
  misc_feature 1, 3, 26, 30, 49, 59, 60, 76, 348, 359: n = A,T,C or G
nantaaaccaagtgaaactaagattnggtntgggatcaataggaaagcntttgcagccnnccaagatgcaaatgtnttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggnataattatggngggtgattatttttt

SEQ ID NO: 57708 - DNA, 187 bp, Homo sapiens
  misc_feature 4: n = A,T,C or G
cccncaggctacctgctcaggaaccccttctgttctctgagaagtcaagagaggacattggctcacgcactgtgagattttgtttttatacttggaagtggtgaattattttatataaagtcatttaaatatctatttaaaagataggaagctgtttatatatttaataataaaagaagtgcacaag

SEQ ID NO: 57709 - DNA, 176 bp, Homo sapiens
tggtatgcttagaagcagattctaaaagcagtttctcctcagaacatcttttttcataccacttgataagcatcttgaaacaccatggctgtagctgcagtaaaatgggtgatgtcaaagagaactatcttgaaacatttatttccagtccaaaatggagctttatattgtgtttg

SEQ ID NO: 57710 - DNA, 308 bp, Homo sapiens
  misc_feature 4, 13: n = A,T,C or G
atgnaaacaatgntttggcatgagccaccagaaacgtacacctgattttcatgacaaatacggtaatgctgtattagctagtggagccactttctgtattgttacatggacatatgtagcaacacaagtcggaatagaatggaacctgtcccctgttggcagagttaccccaaaggaatggaggaatcagtaatcatcccagctggtgtaataatgaattgtttaaaaaacagctcataattgatgccaaattaaagcactgtgtacccattaagatatggcattattgaagaaataaagtacatttg

SEQ ID NO: 57711 - DNA, 169 bp, Homo sapiens
tattcggggtgagtaagtagttgggtataagatctgaacttttcatctgcagaggcaagaaaaatatttgacattgtgacttgactgtggaagatgatggttgcatgtttctagtttgtatatgtttccatctttgtgataagatgatttaataaatctctttaaatac

SEQ ID NO: 57712 - DNA, 400 bp, Homo sapiens
  misc_feature 43: n = A,T,C or G
actattagtataccatcatgtccggaaaacttttaatcttttnaaatatctgatgtaactaccagaaagtcccttacttcctatgaccaatcaggaccaagtcttggaggtgatgtgttacattacgtgcagcacaatagtaccgatcagttaactcagcgctgaagggcttgttttatgaaaggtactattccttctttcacattaactggaaacctctttttttacccgttgttcacaactagttttcttattgactgtattggactgtctcttcttgtagagactgattttggcaacatattaatgcatgttttatgcaaaacacaaatatgatattagttgcttttaaggagttctgcattgtatgtgcatttttgtagaaatggtactggcttat

SEQ ID NO: 57713 - DNA, 396 bp, Homo sapiens
  misc_feature 29, 34, 38, 56, 59, 354: n = A,T,C or G
aggcggcactggtctcgacgtggggcggncagcngatntttccgcccagttcaatncanacaagtgagtttgactcatcagatgaagagcctattgaagatgaacagactccaattcatatatcatggctatctttgtcacgagtgaattgttctcagtttctcggtttatgtgctcttccaggttgtaaatttaaagatgttagaagaaatgtccaaaaagatacagaagaactaaagagctgtggtatacaagacatatttgttttctgcaccagaggggaactgtcaaaatatagagtcccaaaccttctggatctctaccagcaatgtggaattatcacccatcatcatncaatcgcagatggagggactcctgcatagccaggtgctgtga

SEQ ID NO: 57714 - DNA, 397 bp, Homo sapiens
  misc_feature 10, 15, 24: n = A,T,C or G
aaatatgccngaacntagagactntgaggaagacgacaatgaagatactgtttgtagtgatgcagaaaatgaaattaatgaacatgatgtcgtggtccagttgcggcctaatggtgaacgggattacaacatagcaaatactgtttgactttcagaagatgattggtttatttcccttttaaaatgattaggtatatactgtaatttgattttttgctcccttcaaagatttctgtagaaataacttattttttagtattctacagtttaatcaaattactgaaacaggacttttgatctggtatttatctgccaagaatatacttcattcactaatagtagactggtgctgtaactcaagcatcaattcagctcttcttttggaatgaaagtatag

SEQ ID NO: 57715 - DNA, 400 bp, Homo sapiens
  misc_feature 5, 11, 40, 366, 390: n = A,T,C or G
acagnaatctntcccctagtttagagtcctttgcacgaantttagcaaatctatcattttgaatacagtacaagcctggtaatccagtgtatttgggataggccagtggaactcagaactgatacatatatacatgtatgtctatcatattcaatgtctattaggtgtaaatcatctcttcatgtaaaagacactactggtttgagggtagactcgctaggaatattttgccttctgtgacagcaccactatccatcccaatgtaacatttctacaaagggaagatatcttaaccaggcatacttatattgctaggtggaaaatcattctgacaggtttaattccatctattgaatggattattgnatgagctatttgggggagcagatntaaatgacat

SEQ ID NO: 57716 - DNA, 159 bp, Homo sapiens
  misc_feature 3, 9, 33: n = A,T,C or G
ctnaaagangctgaagggatttcttctgatggnagcttttgtattatcaagtaagattctattttcagttgtgtgtaagcaagtttttttttagtgtaggagaaatcttttccattgtttaactgcaaaacaagatgttaaggtatgcttcaaaaattt

SEQ ID NO: 57717 - DNA, 477 bp, Homo sapiens
gtgtgacagggatacagcaactattttatcaattgtttgtatttccctttaaggtaacattttaaatgaaatgtattatattttaatctatccttttcctttgtttttgttcttattatctcttctgatatataaccaaaaaatgaaaaaatctgtacacttggtgtttgatttacctaagcacctagttaatttaatctttgtaacactttggatggttaacttaacctttactcaagttggtttttgttttgttgaaaatgacttacttggtggaaccactactactgaaagaacgaaactttgatattacattgttaagtatcagagctgttacagagcaagtccttttaaagagatgtaaaaattaagtacctgtgccaaactgatttttattagaaaccctgttttctttaagtaaaagtatattctaccagcatggcttggtaagaaaaatcccctatctttttttccctg

SEQ ID NO: 57718 - DNA, 477 bp, Homo sapiens
ataacaatgacctctggcagatttttgaaaatcctgtggactggaaggaaaagtatataaaccgtgattattcaaagattttcactgaaaatatagttgaacagccctgtccagatgtcttttggttccccatattttctgaaaaagcctgtgatgaattggtagaagaaatggaacattacggcaaatggtctgggggaaaacatcatgatagccgtatatctggtggttatgaaaatgtcccaactgatgatatccacatgaagcaagttgatctggagaatgtatggcttcattttatcccgggagttcattgcaccagttacactgaaggtctttgcaggctattatacgaagggatttgcattactgaattttgtagtaaaatactcccctgaacgacagcgttctcttcgtcctcatcatgatgcttctacatttaccataaacattgcacttaataacgtggggagaaga

SEQ ID NO: 57719 - DNA, 430 bp, Homo sapiens
gctcttccggggacgttgtctacaggcactcagaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctaaggtggttccatgtgtgctaaatgtgttcgtgacaggatcaagcgtgctttccttatcgaggagcagaaaatcgttgtgaaagtgttgaaggcacaagcacagagtcagaaagctaaataaaaaaatgaaacttttttgagtaataaaaatgaaaagacgctg

SEQ ID NO: 57720 - DNA, 124 bp, Homo sapiens
aaaggtagcagcagcacgggcatggagagaacggactgggcggacgtttcttaagaagaattctagccatacattgttacaggtgctgagcccccggaccgacattggtgtatatgggagtggt

SEQ ID NO: 57721 - DNA, 498 bp, Homo sapiens
  misc_feature 5, 11, 489: n = A,T,C or G
ctgantcgagnaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccgtctgtctatctatctggctggcagggaaggaaagaacttgcatgttggtgaaggaagaagtggggtggaaggagtggggtgggacgacagtgaaatctagagtaaaaccaagctggcccaaggtgtcctgcaggctgtaatgcagtttaatcagagtgccattttttttttgttcaaatgattttaattattggaatgcncaatttttt

SEQ ID NO: 57722 - DNA, 473 bp, Homo sapiens
  misc_feature 30: n = A,T,C or G
attcctgagctgacagcattcgggccgagnatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattgatatg

SEQ ID NO: 57723 - DNA, 164 bp, Homo sapiens
gatactactttctcgttattttgtgtgtatgcctcatttccctgacttaaacctcactgagagcgcaaaatacagctttatactttttactttcaattgcctagcacaatagtgagtacatttgaattgaatatataataaatattgcaaaataaaatccatct

SEQ ID NO: 57724 - DNA, 473 bp, Homo sapiens
cctcccaccataattctgagcctccccagcctgtggaactgtaagtccaattaaacctctttttcttcccagtctcaggtatgtctttatcagcagtgtgaaaacggactaatacacatggtaattccatgtttaactttttgaggaacagccaaactgttctccacagtggctgcaccattttacattcctgccagctgctcatgaagcttccaatttttccatatctttgccaagatttattattgtctgtctttttgattgtagcctttctagtgggtgtggagtggtatttcattgtggttttgatttgcatttccctagtaattaacggtattgataatcactttcatgaacttatttgccacttgtatgttttctttggataaatgtcttttcaggtcctttgcctattttaaaatggtaccatttgtctttttattgaattataataatattttatgtattctgga

SEQ ID NO: 57725 - DNA, 474 bp, Homo sapiens
gaggagtttgagggcctatattcagcatttttgaagaaaagaatttataatcaagaatttcttattcagccaagctaagtttcataagtgaaggagaaataagatcctttccagacaagcaaatgctaagggaattcattaccaccaaacctgcattacaagaggtgctgaggaagggctaaatatggaaaggaaagactgttactggccactataaaaacacacttaagtacatagaccagtgacactataaagcaaccacacaaacaagtctgcataataaccagctaacaacacgataacattgatcaaatccacatatatcaatatgaaccatgaatgtagacaggctaaatgccccaattaaaaggcacagagtggcaagttgggtaaagaagcaagacccaactgtgtgctgtcttcaagagacccatctcacatgcagtgacatccataggctcaaagtaaagggat

SEQ ID NO: 57726 - DNA, 479 bp, Homo sapiens
  misc_feature 475, 477: n = A,T,C or G
gggcccaagtccttctggtctccctgtctctcttctaactctctacttagacaacaataagatcagcaacatccctgatgagtatttcaagcgttttaatgcattgcagtatctgcgtttatctcacaacgaactggctgatagtggaatacctggaaattctttcaatgtgtcatccctggttgagctggatctgtcctataacaagcttaaaaacataccaactgtcaatgaaaaccttgaaaactattacctggaggtcaatcaacttgagaagtttgacataaagagcttctgcaagatcctggggccattatcctactccaagatcaagcatttgcgtttggatggcaatcgcatctcagaaaccagtcttccaccggatatgtattgaatgtctacgtgttgctaacgaagtcactcttaattaatatctgtatcctggaacaatattttatggggtatgtttttctgngngg

SEQ ID NO: 57727 - DNA, 333 bp, Homo sapiens
  misc_feature 22: n = A,T,C or G
tggagtttcgtaatttcccagnactattttcaagcaacctggtccacccaggattagtgaccaggttttcaggaaaggatttgcttctctctagaaaatgtctgaaaggattttattttctgatgaaaggctgtatgaaaataccctcctcaaataacttgcttaactacatatagattcaagtgtgtcaatattctattttgtatattaaatgctatataatggggacaaatctatattatactgtgtatggcattattaagaagctttttcattattttttatcacagtaattttaaaatgtgtaaaaattaaaaccagtgactcctgtct

SEQ ID NO: 57728 - DNA, 467 bp, Homo sapiens
agctttaatttattaatgcaaacagtacctaacaaacccacaggtcctaaactaccaaacctgcattaaaaatttcggttggggcgacctcggagcagaacccaacctccgagcagtacatgctaagacttcaccagtcaaagcgaactactatactcaattgatccaataacttgaccaacggaacaagttaccctagggataacagcgcaatcctattctagagtccatatcaacaatagggtttacgacctcaatgttggatcaggacatcccgatggtgcagccgctattaaaggttcgtttgttcaacgattaaagtcctacgtgatctgagttcagaccggagtaatccaggtcggtttctatctacttcaaattcctccctgtacgaaagggcaagagaaataaggcctacttcacaaagcgccttcccccgtaaatgatatcatctcaacttagtatta

SEQ ID NO: 57729 - DNA, 420 bp, Homo sapiens
tgcacaaactgtcacttggttaatttaagcacttctgttttcgtgaatttgcttgtttgtttcttcatgcctttacttactttgtcccatgctactgattggcacgtggcccccacaatggcacaataaagcccctttgtgaaactgttctttaaatgaaacacaaggaattggccactggtaaaactctgcagcttcaactgtacttcatttaatgccattaatgcaaatatacttcctcttctttttgcatggttttgcccacctctgcaatagtgataatctgatgctgaagatcaaataaccaatataaagcatatttcttggccttgctccacaggacataggcaagccttgatcatagttcatacatataaatggggggtgaaataaagaaataaaacacaatacttttacttg

SEQ ID NO: 57730 - DNA, 414 bp, Homo sapiens
  misc_feature 24: n = A,T,C or G
ctggaatgggaggctacggaaganaggaatggataatcagggaggctatggatcagttggaagaatgggaatggggaacaattacagtggaggatatggtactcctgatggtttgggtggttatggccgtggtggtggaggcagtggaggttactatgggcaaggcggcatgagtggaggtggatggcgtgggatgtactgaaagcaaaaacaccaacatacaagtcttgacaacagcatctggtctactagactttcttacagatttaatttcttttgtattttaagaactttataatgactgaaggaatgtgttttcaaaatattatttggtaaagcaacagattgtgatgggaaaatgttttctgtaggtttatttgttgcatactttgacttaaaaataaatttttatat

SEQ ID NO: 57731 - DNA, 402 bp, Homo sapiens
cggacgaatcggcgtttgccgaggctggcatagatttggctgtctccgctcatagctgcttttggcgcgaaagatgccgggtctggttgactcaaaccctgccccgcctgagtctcaggagaagaagccgctgaagccctgctgcgcttgcccggagaccaagaaggcgcgcgatgcgtgtatcatcgagaaaggagaagaacactgtggacatctaattgaggcccacaaggaatgcatgagagccctaggatttaaaatatgaaatggtggtctgctgtgtgaataaataattcctgaagaatgaagaagattaattttgggagttctttgacgaactttgatatgtggaaaaagtatttataattttattgtaagaagaaagtaaaatattactagtgg

SEQ ID NO: 57732 - DNA, 398 bp, Homo sapiens
  misc_feature 10, 25, 354, 366: n = A,T,C or G
ctgattaagnacggttgaaactagngatggacaggttatcaacgaaacttctcagcatcacgatgaccttgaataaaaattgcacacactcagtgcagcaatatattaccagcaagaataaaaaagaaatccatatcttaaagaaacagctttcaagtgcctttctgcagtttttcaggagcgcaagatagatttggaataggaataagctctagttcttaacaaccgacactcctacaagatttagaaaaaagtttacaacataatctagtttacagaaaaatcttgtgctagaatactttttaaaaggtattttgaataccattaaaactgcttttttttttccagcaagtntccaaccaactnggttctgcttcaataaatctttggaaaaactc

SEQ ID NO: 57733 - DNA, 471 bp, Homo sapiens
  misc_feature 9: n = A,T,C or G
tggcccggnagttcggtgcagctgccagatccgctgatctagcgcttctcgaaaaaaaccttcaggcggcccatggctgtcgatattcaaccagcatgccttggactttattgtgggaagaccctattatttaaaaatggctcaactgaaatatatggagaatgtggggtatgcccaagaggacagagaacgaatgcacagaaatattgtcagccttgcacagaatctcctgaactttatgattggctctatcttggatttatggcaatgcttcctctggttttacattggttcttcattgaatggtactcggggaaaaagagttccagcgcacttttccaacacatcactgcattatttgaatgcagcatggcagctattatcaccttacttgtgagtgatccagttggtgttctttatattcgttcatgtcgagtattgatgctttctgactggtacacgatgctttac

SEQ ID NO: 57734 - DNA, 489 bp, Homo sapiens
  misc_feature 6, 8: n = A,T,C or G
gagaancntgagggaaattgtggagttagcctcctgtggtaaaggaattgaagaaaatataacaccttacaccctttttcatcttgacattaaaagttctggctaactttggaatccattagagaaaaatccttgtcaccagattcattacaattcaaatcgaagagttgtgaactgttatcccattgaaaagaccgagccttgtatgtatgttatggatacataaaatgcacgcaagccattatctctccatgggaagctaagttataaaaataggtgcttggtgtacaaaactttttatatcaaaaggctttgcacatttctatatgagtgggtttactggtaaattatgttatttttttacaactaattttgtactctcagaatgtttgtcatatgcttcttgcaatgcatattttttaatctcaaacgtttcaataaaaccatttttcagatataaagagaattacttcaaattgagtaattcag

SEQ ID NO: 57735 - DNA, 165 bp, Homo sapiens
  misc_feature 8, 10, 53: n = A,T,C or G
aatcaagnanaaacttcaaagttaatgggttggtcggatctcacaggctgagnaactcgttcacctccaagcatttcatgaaaaagctgcttcttattaatcatacaaactctcaccatgatgtgaagagtttcacaaatccttcaaaataaaaagtaatgactt

SEQ ID NO: 57736 - DNA, 292 bp, Homo sapiens
  misc_feature 11: n = A,T,C or G
tactgttgagnatgttcaacaattttggttatctttgagcagagttatcttggacaccaatgggttatgttgttcgacagacattatctacagaactgtcagcagcccctaaaaatgttacttctatgataaacttaaagaccattgcttcatcagcagatcctaaaaatgttagtataccatcttctgaagctttatcttcggatccttcctacaacaaagaaaaacacattattcatcctacccaaaagtctaaagcatcacaaggtagtgaccttgaacaaaatgaagc

SEQ ID NO: 57737 - DNA, 139 bp, Homo sapiens
  misc_feature 13: n = A,T,C or G
aactttgcacatnagctcctatagggcctggtgctgtggctcactcctgtaatcccaatactttgagagatgaaggcaggaggattgcttgaagccagagttgagatgatcctgggcaacaaaacaagaccccagctca

SEQ ID NO: 57738 - DNA, 463 bp, Homo sapiens
  misc_feature 34: n = A,T,C or G
taggagcctctctccctactgctgctacacaagnaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacatag

SEQ ID NO: 57739 - DNA, 278 bp, Homo sapiens
  misc_feature 251: n = A,T,C or G
actgttaattgcacataaacatgaaatgtgttttcccctgtgtactaacacattctaggcaaaattcaaacttatagtggtaaagaaacaggttgttcacttgctgaggtgcaaaaattcttaagacttctgtttgaaattgcccaatgactaggaaaagatgtagtagtttactaaaattgtttttctaccatatcaaattaaacaattcatgcctttatagggtcaggcctacaatgaataggtttggngggttcacagaattttaaaatagagtt

SEQ ID NO: 57740 - DNA, 474 bp, Homo sapiens
ctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaatttgtatttgaaaacacttagtatgcagttgataagaggaaatttggt

SEQ ID NO: 57741 - DNA, 467 bp, Homo sapiens
  misc_feature 303, 329, 342, 361, 406, 410, 441: n = A,T,C or G
gtcccgcaggtcgctttgcagaacgggagcgcgcttaagtaactagtccgtagttcgagggtgcgccgtgtccttttgcgttggtaccagcggcgacatgacggggtacactccggatgagaaactgcggctgcagcagctgcgagagctgagaaggcgatggctgaaggaccaggagctgagccctcgggagccggtgctgcccccacagaagatggggcctatggagaaaattctggaataaatttttggagaataaatccccttggaggaaaatggtccatggggtatacaaaaagagtntctttgttttcactcatgtacttgtncctgtctggattnttcattattacatgaagtntcatgtttctgaaaaaccatatggcatagttgaaaagaagtccanaatnttccctggtgatacaattctggagactgganaagtaattccaccaatgaaagaattt

SEQ ID NO: 57742 - DNA, 474 bp, Homo sapiens
gcattcctgagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattgatatg

SEQ ID NO: 57743 - DNA, 278 bp, Homo sapiens
gcaacagccaaacccaatattattagaaggaaagcagtaataaagatcagagcaaaaataaatgaaattgagactataaaacaatacagaggataaatgaaacaaagagttaatttcttgaaaagatgaacaaaattaacaaatacctttagatgactaagaagagagagaatccaaataaataaaatgagatgaaaaaggaaacattacaactcataccacagaaatacaaaggatcactacagactgttatgaacaactacataccaacaaattgg

SEQ ID NO: 57744 - DNA, 487 bp, Homo sapiens
aattcagttttgttctacttcctccccttccttccgatgataacatcacatctctacagtaagtgcctctgccagcccaacccaggagcgcaagttgtctttgccatctggtctatagtacagtgcgcggcgttaggccacaactcaaaagcattatcttttttagggttagtagaaattgttttatgttgatgggaggtttgtttgattgtcaaaatgtacagccacagccttttaatttgggagcccctgttgtcattcaaatgtgtacctctacagttgtaaaaagtattagattctactatctgtgggttgtgcttgccagacaggtcttaaattgtatattttttggaaaagtttatatactctcttaggaatcattgtgaaaagatcaagaaatcaggatggccatttatttaatatccattcatttcatgttagtgggactattaacttgtcaccaagcaggactctatttcaaacaaat

SEQ ID NO: 57745 - DNA, 471 bp, Homo sapiens
accgacgggaaggtaaaaagccgcgtcggcttcacctaccttcttgtactccgaggaggttttccagtttcttaatgcgaaatgcgagtcggctttcctttccaagaggaatcctcggcagataaactggactgtcctctacagaaggaagcacaaaaagggacagtcggaagaaattcaaaagaaaagaacccgccgagcagtcaaattccagagggccattactggtgcatctcttgctgatataatggccaagaggaatcagaaacctgaagttagaaaggctcaacgagaacaagctatcagggctgctaaggaagcaaaaaaggctaagcaagcatctaaaaagactgcaatggctgctgctaaggcacctacaaaggcagcacctaagcaaaagattgtgaagcctgtgaaagtttcagctccccgagttggtgggaaaacgctaaactggcagattagattttt

SEQ ID NO: 57746 - DNA, 359 bp, Homo sapiens
  misc_feature 5, 6: n = A,T,C or G
aaganncttggatttaaaggtgtatggaagggactgtttgcccgtatcatcatgattggtaccctgactgcactacagtggtttatctatgactccgtgaaggtctacttcagacttcctcgccctcctccacccgagatgccagagtctctgaagaagaagcttgggttaactcagtagttagatcaaagcaaatgtggactgaatctgcttgttgatcagtgttgaagaaagtgcaaaaggaacttttatatatttgacagtgtaggaaattgtctattcctgatataattactgtagtactcttgcttaaggcaagagtttcagatttactgttgaaataaacccaactcttcatt

SEQ ID NO: 57747 - DNA, 473 bp, Homo sapiens
tatgaaaaggagggctagtaggtgctggagatacaataaaggctacagccaaactgacattttctgacaactgggattgaaagagaaatgaaaagttaataattcttgtgttgtgtccttaagccacagttcagtataatttactccttcctttttataacagattttttactgtctcctgaagaatttaacacaaacatggatatcaggaccaaatcatacaatttatatcaacaatatgaatgacaaaattaaaaaggaaggattgaagagatccctatatgccctgttttctcagtttggtcatgtggtggacattgtggctttaaagaccatgaagatgagggggcaggcctttgtcatatttaaggaactgggctcatccacaaatgccttgagacagctacaaggatttccattttatggtaaaccaatgcgaatacagtatgcaaaaacagattcggatataatat

SEQ ID NO: 57748 - DNA, 297 bp, Homo sapiens
taactttacaaagtaaggtacattgatataattcatttaacaaatacgtattgattacccactttgcgcaaggtaatatgctaagtgctcgaggtagaagagtaaaagtaatagaaaatcttcatcttcattgaggtaaaatttcagcagatagtttaaaataatttgagtttaaattttatttcattgtatacctgtaaaacccaaaagaatccacgaaaaaattataaacagtaagagaattcaataaagtagctgcttacaaaacaggcaaaaataaatagacttccaatgaga

SEQ ID NO: 57749 - DNA, 474 bp, Homo sapiens
  misc_feature 22, 470: n = A,T,C or G
gtagctaccacatcaagggagnagaagaggcttgcgtactttgggttgatctcactgtacaaaaaaaagtgtacccctattggaagaaataaggaatacttgaaggtttctcctttttttacacttgagtcatgtgcaaggttgaaccatatgaaattgccagtgttcaaccattgctgatctgcaaaagcgacaatatcatatgcctcaacctaacacttactcttaaatgcaggttaaaatctctgtgaggcaaagggataatattctctaggaactcacttttgagagtatttttctctaacccatgtggatctaaattttaaaaataggaatgaatctcttaattgcagcttgtggagagtataaaacattttgagcacaatatgcagcacataacttttcagattgtgtttgcatagaaaaggttaaaatcaattctttcagttactgtattgttcatttcttgnaaag

SEQ ID NO: 57750 - DNA, 364 bp, Homo sapiens
  misc_feature 12: n = A,T,C or G
tatcagctaagnagtcctccaatcctggtcccattaactccaagtgcctttttgacagtgacaacagacagtccctcgctttttgttgttgttggttttcttaacccctttaatggaactgcctggattttatacagttattaaaggatgtctcttttgctttaaactgcatgctgccaagtgccatttggggtcagcatcctcgtttcaacacagtgtgctctctagttatcatgtgtaacgtgggttctgtttagcgaagatagactagaggacacgttagagatgcccttccctgctccatccctgtggcaccattatggttttttggctgtttgtatatacggttacgtattaactctgg

SEQ ID NO: 57751 - DNA, 242 bp, Homo sapiens
atagcaaaatgaaagagaacatgaaatgcttctttctcagtttattggttgaatgtgtatctatttgagtctggaaataactaatgtgtttgataattagtttagtttgtggcttcatggaaactccctgtaaactaaaagcttcagggttatgtctatgttcattctatagaagaaatgcaaactatcactgtattttaatatttgttattctctcatgaatagaaatttatgtagaagcg

SEQ ID NO: 57752 - DNA, 200 bp, Homo sapiens
cagattgtctcttctatattgaaagcatttttatgttttctaatttaaaaattaatattttcttatagatattgtgcaataaagctgaagtagaatgtgtggtttttgcaaatgctttaacagctgataaaaattttacatttgtaaaattaatatattgtactggtacaaaatagttttaaattatattttaaaaagtt

SEQ ID NO: 57753 - DNA, 466 bp, Homo sapiens
  misc_feature 1, 2: n = A,T,C or G
nngaagtcttacacatataaagacccaattacagaatttgttgaatgtttatatgttaactttgactttgatggggctcagaaaaagctgagggaatgtgaatcagtgcttgtgaatgacttcttcttggtggcttgtcttgaggatttcattgaaaatgcccgtctcttcatatttgagactttctgtcgcatccaccagtgtatcagcattaacatgttggcagataaattgaacatgactccagaagaagctgaaaggtggattgtaaatttgattagaaatgcaagactggatgccaagattgattctaaattaggtcatgtggttatgggtaacaatgcagtctcaccctatcagcaagtgattgaaaagaccaaaagcctttcctttagaagccagatgttggccatgaatattggagaagaaacttaatcagaatagcaggtcagaggctcctaactgg

SEQ ID NO: 57754 - DNA, 401 bp, Homo sapiens
  misc_feature 1, 10: n = A,T,C or G
naattcggcnttatggccggaagaatacatacttattcccatttttaagcatttgcttctgttttccctacctagaatgtcagatgtttttcagttatctccccatttgtcaaagttgacctcaagataacatttttcattaaagcatctgagatctaagaacacaattattattctaacaatgattattagctcattcacttattttgataactaatgatcacagctattatactactttctcgttattttgtgtgcatgcctcatttccctgacttaaacctcactgagagcgcaaaatgcagctttatactttttactttcaattgcctagcacaatagtgagtacatttgaattgaatatataataaatattgcaaaataaaatccatctaaataga

SEQ ID NO: 57755 - DNA, 315 bp, Homo sapiens
gagatacgctagtaactgtgataccatactataaaacagaagaattttctgctactaaaaactgcctttttacaaaatgactgtaaatatttgtaaaataaaataacactaaactttaagcccaaaaggagagatagagccatgtgttcagttgtggacctgtccgtggggcacagtgccaccccatcacagtgttgctgtcatcaggcaaaagtgaatgtttgtttatggcaaattcgtcttttgcgaatggcttaattctgacactacctttctgggaaatgttaataaatttttaatattcaaaaaaaaagg

SEQ ID NO: 57756 - DNA, 116 bp, Homo sapiens
atctatgcccaaaacagctgaatttgtcacatttatatattgcaatatgggaagtattgagatcaaaacaggattccattgacctaattatattaagctaataaactaattttttg

SEQ ID NO: 57757 - DNA, 461 bp, Homo sapiens
  misc_feature 264, 295, 386: n = A,T,C or G
atagcagctctggttagacaagtgatcataaaaaagaaagaggatctatgagaatgccattgcgtttctaatagaacagagaaatgtctccatgagggtttggtctcattttaaacatttttttttggagacagtgtctcactctgtcacccaggctggagtgcagtagtgcgttctcagctcattgcaacctctgcctttttaaacatgctattaaatgtggcaatgaaggattttttttttaatgttatcttgctattaagnggtaatgaatgttcccaggatgaggatgttncccaaagcaaaaatcaagagtagccaaagaatcaacatgaaatatattaactacttcctctgaccatactaaagaattcagaatacacagngaccaatgtgcctcaatatcttattgttcaacttgacattttctaggactgtacttgatgaaaatgccaacacac

SEQ ID NO: 57758 - DNA, 211 bp, Homo sapiens
gttggagcctcaggaagaaccgcaaaagacagtccaacgagacttatcgagatgctgttcgaagagtcatgtttgctcgatataaagaactcgattaagaaaggagacaagttccatgggatacaacctccctcttgttttgtttgtctctccttttcttttgttactgttcttgctgctagaacttttttaaataaactttttttcaatg

SEQ ID NO: 57759 - DNA, 451 bp, Homo sapiens
  misc_feature 1, 3, 5, 14, 22, 37, 179, 186, 254, 281, 290, 321, 327, 335,359, 369, 432, 434, 441: n = A,T,C or G
nantncatatctgnagtgcctnatggcaaatcccttncccgatctttgtagcaccatctactggcagaatggcagagtagctgcgaaacaatttgtttaaaaacttgcttaagacaattgcatcagatttggaagttttgccatcaaaattctttgcagaattggaagttaacacattngcttgtnactgagatgggcttcacaggaatgtagttgccagttcatatcacaatagccctttctatatgaggttngaaaatgtaaactgctatgcatagctngggcaatanccctaaattgctatgacaactaatgaaccanctacgnatactggnattttaggtgcaagttgtaaagcnaaatatctgngtattctgcttggttaacaaatgtatatttgtagccctttcctgcaatagcattcaagttgtngnttataangagaagaaca

SEQ ID NO: 57760 - DNA, 471 bp, Homo sapiens
  misc_feature 19, 470: n = A,T,C or G
gaaagtggcaaacccaggnaattgaacctcagagttttcaatctctcctatatacacaacggttaaatgtaccatatacctaatcatatttcctgacctccaaaaaagaataaagagaaaataagatacttctttctgtttatgattaaggcagatgaatgtatgctgaagttatttcttaagtaaaaatttatttacagatacactattgatttaaatttaagaagcataccacttttttaggtaaaatagaaaatcaaattttgcaaaataaaacaacttagaaagcataccaatatttctactcctacatatggtacaattatattatcctatttagtaaaacaaatgataattcttcattaactcagatttaccaagatgtatatcaggttaccctggttaatagtttgagatgaatgtttaacattatctctgtatgattattaagactacataataattttggng

SEQ ID NO: 57761 - DNA, 148 bp, Homo sapiens
  misc_feature 11: n = A,T,C or G
ctcttccccgngaagggtatccgcctcaccattgctgaagagagagacaaaagactggcggccaaacagagcagtgggtgaaatgggtccctgggtgacatgtcagatctttgtacgtaattaaaaatattgtggcaggattaatagc

SEQ ID NO: 57762 - DNA, 211 bp, Homo sapiens
cagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaacactctttatgataacagg

SEQ ID NO: 57763 - DNA, 228 bp, Homo sapiens
gtggatcacctgagtcaggagttcgagaccagcttggccaacatgccgaaaccctgtctctactaaaaatacaaatattagccgggcatggtggcggacacctgtaatcccagttacttgggaggctcaggcaggataatcgcttgaacccagaaggcagaggttgcagtgagccaagatcgcaccactgcactccagcctgagcaacagagtgagactctgtctcgg

SEQ ID NO: 57764 - DNA, 481 bp, Homo sapiens
  misc_feature 10: n = A,T,C or G
acctgaaaangcagaaaatgcctggaagccagccaaaaacgagacaaccaagccgatgatcccgaaaacattaaaacccaggagctttttagaaaagttcgaagtatcttaaataaattgacaccacagatgttcaatcaactgatgaagcaagtgtcaggacttactgttgacacagaggagcggctgaaaggagttattgacctggtctttgagaaggctattgatgaacccagtttctctgtggcttacgcaaacatgtgtcgatgtctagtaacggtaagaagagaggaaggagtaaaacgagaaatcttcaagagctgaaagtacccatggcagacaagcctggtaacacagtgaatttccggaagctgctactgaaccgttgccagaaggagtttgaaaaagataaagcagatgaatgatgtctttgagaagaagcagaaagaacttgaggctgccagtgctccagaggagagga

SEQ ID NO: 57765 - DNA, 413 bp, Homo sapiens
  misc_feature 412: n = A,T,C or G
tccttatattaaataaagtcttcccaactaaatctagagagtaaatgagttacttatctgggacatgtgattttgtgccagatcattttaatattcatagttttataattctattgggaacaacttatttttatgtactaatctcaatctcttaacatgtattcagtagtcagtaaaacttctaaattccagaagagaaattatcaaaaattatttgcaatgattgttttcaagagtcagtttacactctcccaaggcacctgctttaaatggattattaattagcttttgtaagttctgacatgccttttgaaaaagtctggccacaattttatatagccataactcatatttcataatatattgtatatttaatagcttcctttgacctataatgaaactagtgacttant

SEQ ID NO: 57766 - DNA, 400 bp, Homo sapiens
ggtagctcatatccaagaatgagtcacaaaaccagactcgttgaacctggtatatgatgagtcacaaagcaacattctgcctttgttttttcaggacaagaaacttgaattgtatcccactgagttaaaagataaaatatatggcattggcatttctgtacttcagagaggaatatatctgtttgtggtaggaataaaaaataagtgagagaggcaaagcttaggttcatcatattatgttactgatataacacaattaacttggtaaaagtgaaggtgtgggtgggcgtggtggctcacgcttgtaatcccagcactttgggagtccgaggcgggtggatcacctgaggtcgggagttcgagaccagcctgaccaacatggagaaaccccatctctact

SEQ ID NO: 57767 - DNA, 168 bp, Homo sapiens
gaccagtgagccaaattttaagtaaacagaaatggaaggtgctaaacaaacaaactccagccaaatggaatatccaaggtctggatggccagctgccacttttgagttgttttccagcgtagaaccctctagttaggctgcagcatttcagattggaaaaaccagacc

SEQ ID NO: 57768 - DNA, 117 bp, Homo sapiens
atcttgaatttagactaaaagagccagtttttaaataatggggcattgttttgactcccataaaaattttcaatgtttattatactgttgaaagcatactatacattgtgtgtgtgt

SEQ ID NO: 57769 - DNA, 318 bp, Homo sapiens
gacaaagaaaactgatcccagtggactatctaaaacaataatctgccatgtggaaggttttccaaagccagccattcaatggacaattactggcagtggaagcgtcataaaccaaacagaggaatctccttatattaatggcaggtattatagtaaaattatcatttcccctgaagagaatgttacattaacttgcacagcagaaaaccaactggagagaacagtaaactccttgaatgtctctgctataagtattccagaacacgatgaggcagacgagataagtgatgaaaacagagaaaaggtgaatgaccaggc

SEQ ID NO: 57770 - DNA, 477 bp, Homo sapiens
gcaatatttaaaaaaaaacactgcaattgtcaaggatggaaaatgtgtgatttgtgtaaacaatttttaccaactttacattttcctacagataaatgtgaaattttgataagaagtctacgcaatgacaagtatggtacataaattttattaagaatattgagtataaagtactttaattctaaattataagaaaatatacatttgcacttattaatatagaaattcattttgtgtatatttaacatagcttttaaactattttacattagctacttcattatggtttcttgaacttctgaaaaaaattagaaatgtattaaacttatcagtaacataaaaacttattttgtttcacctaacgaatactgcgtttgtaaaaataaattaatatagaatatatttttaaattaaatatttgaatataaaatagctctaagaaagaagcaaattatcactgaacatatttcttattat

SEQ ID NO: 57771 - DNA, 157 bp, Homo sapiens
gagatgcaagcattttgaactgggaggagataagaagagaaagggcctagtgatccagttctaaactttgggatatttttcttcaattttgaagagaaaatggtgaagccatagaaaagttacccgagggaaaataaatacagtgatattcttacac

SEQ ID NO: 57772 - DNA, 245 bp, Homo sapiens
  misc_feature 2, 12, 13: n = A,T,C or G
gnaaataaaaanntcctgcatttatggtgtagttctgagtcctgagacttttctgcgtgatggctatgccttgcacacaggtgttggtgatggggctgttgagatgcctgttgaaggtacatcgtttgcaaatgtcagtttcctctcctgtccgtgtttgtttagtacttttataatgaaaagaaacaagattgtttgggattggaagtaaagattaaaaccaaaagaatttgtgtttgtctgat

SEQ ID NO: 57773 - DNA, 478 bp, Homo sapiens
cagaccttatccagtctggtacaactgtccttagactgatgagcaaaggaggagtcaactaatgaagaaatgaataataaattttgacactgaaaaacattttattaataaagaatattgacatgagtataccagtttatatataaaaatgtttttaaacttgacaatcattacactaaaacagatttgataatcttattcacagttgttattgtttacagaccatttaattaatatttcctctgtttattcctcctctccctcccattgcatggctcacacctgtaaaagaaaaaagaatcaaattgaatatatctttttaagaattcaaaactagtgtattcacttaccctagttcattataaaaaatatctaggcattgtggatataaaactgttgggtattctacaacttcaatggaaattattacaagcagattaatccctctttttgtgacacaagtacaatctaaaagtta

SEQ ID NO: 57774 - DNA, 474 bp, Homo sapiens
tactataaaatgctctatagggagacaaagtgtttcttttttcttttatgtttactgtttatgtggagtgaaatataaggctcttggatgtataacatactcaaaagctgttacactttctctgatctgctgtgatccactgaaaatgtgctggggtttgttctgctgtcactgtttatgctgctggaacttagcactgtcttgatttgaagcatatgattgagagccatttgaagcaatcttcattaatgcagataaaacaagtttacatgtgcagagttagaaaatgacatgttcaattctgtaagtggtgacctttttgagcacctttcagtattatgtatttgtaaaaaccattgtttttggatataaagctaataagcactttaaaaaggaaaaggcagcctttactattttttctggttgagtcattgctctttagacctagcatcagcaatagatttcaaagataag

SEQ ID NO: 57775 - DNA, 472 bp, Homo sapiens
aagatttgcagttaattaggatttgcattttaagtagttaggaactgcccaggtttttttgttttttaagcattgatttaaaagatgcacggaaagttatcttacagcaaactgtagtttgcctccaagacaccattgtctccctttaatcttctcttttgtatacatttgttacccatggtgttctttgttccttttcataagctaataccactgtagggattttgttttgaacgcatattgacagcacgctttacttagtagccggttcccatttgccatacaatgtaggttctgcttaatgtaacttcttttttgcttaagcatttgcatggctattagtgcttcaaagtcaatttttaaaaatgcacaagttataaatacagaagaaagagcaaccccaccaaacctaacaaggacccccgaacactttcatactaagactgtaagtagatctcagttctgcgttatt

SEQ ID NO: 57776 - DNA, 467 bp, Homo sapiens
gatttttataggatgaagttatttattttctattttcactgttttgcatattgctgttaataagcattgtaatcatgctggcattttgcaatcccagtcggtatgccttctaaaaactgagggaaacttactggggaaatagaataacaatctccatttttttctttactatctaaaagtttatcggtatcttgatgtatatatatatattaaggtgtggctgtttaaaattctaatgacatatatcaacacattcaatggctgttgttaacctttgaagtaaaaaggagatcactttttaccaaataaccaaaaatttttagtctttgtcaaagtgcacaggtatgttctcagaacatttttcacaatgtgtatcagaaatatgtttgctatccttagagacagaaatgaatataacaaattgatctgcttatttattaaaattattattctagacttacaaaggg

SEQ ID NO: 57777 - DNA, 464 bp, Homo sapiens
gcaacatatttagggaataataattattttctatcgtttcatgttgtaggttgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgtctacaataaaaagaaattttgcctgccattttcagaatcatcttttgaagctttctgttg

SEQ ID NO: 57778 - DNA, 456 bp, Homo sapiens
taagggcttaacctgtgactttaataagctggaacagtccactgaatgggtataatgaattgcagtatatacgtatgattgctttttaagtgattatcttttcttctgttaagtcatgtaaattcataaatccttttgcactgatgtgttgaaccttattcttgtacattcattcaatcaaggcaaacttttataatttttcttttgtttccaatgaccttgaaatgttatagcatggtaatattctatgcaactatagttatactttttggtttgacactgtattttttcacattgatttactggttgatgatagattttataacctaacggttctcatgcggtgcgtaattgtagatgcatgtacttgtgtgttttgtgtaattatttgaagtgcaatgatgtataaaaaagtggattcaccctgtttttaaaaataaaacattgataaaaggt

SEQ ID NO: 57779 - DNA, 403 bp, Homo sapiens
  misc_feature 1, 9: n = A,T,C or G
nattcggcnttatggccgaggtgggaggatttgatgtaagttactgacaagcctcagcaaacccaaagatgttaacagtattttaagaagttgctgcagattcctttggccactgtatttgttaatttcttgcaatttgaaggtacgagtagaggtttaaagaaaaatcagtttttgttcttaaaaatgcatttaagttgtaaacgtctttttaagcctttgaagtgcctctgattctatgtaacttgttgcagactggtgttaatgagtatatgtaacagtttaaaaaaaaagttggtattttataagcacagacaattctaatggtaacttttgtagtcttatgaatagacataaattgtaatttgggaacataaaaactactgaataaatcatgtggcct

SEQ ID NO: 57780 - DNA, 415 bp, Homo sapiens
  misc_feature 414: n = A,T,C or G
taataaagacaataatttgagagtgtgtggaagtccccctaatagaagccaactatctaatcaatgccaaaagtgtgaacaaaatagagaaaggaagcagtgaaaaagaatgcaactttttcttaccattcaaagtacaggatcacagcataaaagaatcataagataaaacatcaaactacccagcaacctgagaagcacagagtgttaaagcctccaccgtgtggagaaactaaattagggtaactagctattgagtatattgagtaccttcaaagcactcaactgacaggttttacagactggaaattataatacttatgacatttctaccttttatataaccaataatctaccatagaatgtagtattttttaaagctattaacaagcaatatattaaaataataatgtnt

SEQ ID NO: 57781 - DNA, 124 bp, Homo sapiens
  misc_feature 20, 77, 92, 114: n = A,T,C or G
aagaaaaatcttgtgctagnaatactttttaaaaggtattttgaatactattaaaactgcttttttttttccagcangtatccaaccaactnggttctgcttcaataaatcttnggaaaacctc

SEQ ID NO: 57782 - DNA, 275 bp, Homo sapiens
cgcagtggttcacgcctgtaatcccagcactttgggaggctgaggcgggcagatcacctgaggttgggaggtcaagaccagcctgaccaacatggagaaaccccgtctctactaaaaatacaaaattagccggtcgtggtggcacatgcctgtattcccagctactcgggaggctgaggcaggagaatcacttgaacccgggacacagaggttgcagtgagcccagattgcgccattgaactccagcctgggcaacgagaacgaaactctgcctc

SEQ ID NO: 57783 - DNA, 474 bp, Homo sapiens
  misc_feature 9: n = A,T,C or G
cactaaagnaggacgttcactacgctcagttttaaaacctgtactttaaaagttgtaatattactagcacatatatgcaagcacctagtataatttctttgtaatatgtgaaactttattaatgtattaaatattacaactagctaaatttattgtcactgtgtatataatgttttgaagtgacatctatttttataaagtactgtttagttggaaaaagttgccttaatgtttgaaatgtgtgaaatttttggaacttgctggacagggtgatttaatttttagctacataattttaagaattagtattttcagtggtgtgcatattttggttcttaaatttttgcttcttaaactaaaaaaatcctgaccaatttatttgttgttttctgtgggttgcgacccatgcaatcaaaaagcaaaattttgattgagattttttacagcataggtttttcatataaaaatattctg

SEQ ID NO: 57784 - DNA, 311 bp, Homo sapiens
agaaggaggaataacaggtctcaaggggaacgagcaattttgtttcatacacgtaaagtggaaagcgctctgggttaagctggagcccaggagtaagggtcagatttgggagccatgatcactacggttgtgtcagtggccagcacagccaagatgtgaacgtatgtagaggagcagacctaggtcttccgagtcctactggtgcttatttctattctagacccaaagggagaatttctgtagtctataccatgcatgcagaaatgtttagtgtgaactgctgtccacaatttactttgaaatgcatttta

SEQ ID NO: 57785 - DNA, 385 bp, Homo sapiens
gaataccctttatttccttatcctgcctaattgccctggccagaacttccaacactatgttgaataggagtggtgagagagggcatccctgtcttgtgccagttttcaaagggaatgcttccagtttttgcccattcagtaaacatggaaaaatagcaaattagagacagtgggtattaacaattgcatatatcacaataaatatatgtttaatctcaggaatgcatggcagttctgtctttagaaaatgtattttttgtatttttatcaatttagagatgcccttttaaaaaaacatattacaaattggaatattcaaagggcagctgttttattttcttccttgctgaaacataaaataatgacgtgttttaaaatttataga

SEQ ID NO: 57786 - DNA, 490 bp, Homo sapiens
  misc_feature 1, 11, 18, 21: n = A,T,C or G
naaatattagnaaacagnagnaggggcattacaaatcccatggacattaaaagaataataaaggaatactgtgaacaagtccatgcccacaaatttgataacctaggtgaaactgaccaattccttgaaatacgcaatctaataaaatacaagaagtaggcagtctgaataggcctatatctagtaagaggttgaatcaatagaaactttccaaagcagaaagcaccaggcccagatgggttcactggtgaattctaacaaacatttaaggaagaaattgtgccagttctctacaatctcttccagaagatagacacagaaggaatacttcctgattcattttatgaggccagcattaccctaataccaaaaccagacaaagacattataagaaaactactgatcattatatctcatgaagatagatgcaaaaacccttaacaaaatattagcaaatgaaaatccaacaatatgtaaaaagaattatata

SEQ ID NO: 57787 - DNA, 194 bp, Homo sapiens
  misc_feature 10, 47, 58, 85, 92, 110, 131, 158, 190: n = A,T,C or G
caggctgaantactaagattccccgacatgaatcatcttatcctatncgaaggaacangacatgtctctctgccaagaatccatnataaacnggagtgatgtcacgcaanacccagcttagaagtctcttntttctttcttaagccctttgctctggnggaagctctggcagcttcagactcaacatcanagct

SEQ ID NO: 57788 - DNA, 462 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagggaaaggactacagagccccgaattaataccaatagaagggcaatgcttttagaaaaatgaaggtgacttaaacagcttaaagtttagtttaaaagttgtaggtgattaaaataatttgaaggcgatcttttaaaaagagattaaac

SEQ ID NO: 57789 - DNA, 424 bp, Homo sapiens
  misc_feature 12, 19, 22: n = A,T,C or G
ggatgaaatagnactcagnagnaagtattgaacctccacataaaaggctttgtttgtcctctgaggatgatcagagtattgatgattctactccttgcatatcagttgttgcacttccactttcagaaaatgatcagagctttgaagtgaccatgactgcaaccacagaagtagcagatgatgaggttactgaggggactgtgacacagatacagattttgcagaatgagcaactagatgaaatatctcccttgggtaacgaggaagtttcagcagttagccaagcatggtttacaactaaagaagataaggattctctgactaataaaggacataaatggaagcaggggatgtggtccaaggaagaaattgatattttgatgaacaatattgaacgctatcttaaggcacgcggaataaaaga

SEQ ID NO: 57790 - DNA, 132 bp, Homo sapiens
gtagcagtcaaggagccgacaaaataaatatcacctcttcattagattaatcttgccattttcaaaattcagaaaggttatcatacattgagtagatgtattttgcagaagttcaagcttatttaaaatcac

SEQ ID NO: 57791 - DNA, 485 bp, Homo sapiens
  misc_feature 3: n = A,T,C or G
gangcattgaggcagccgcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttg

SEQ ID NO: 57792 - DNA, 297 bp, Homo sapiens
  misc_feature 2, 17, 36, 43, 51, 58, 62, 63, 130: n = A,T,C or G
tntggcccggggcacantgtgggcttcaatgtcaancaatgtntctgtccnagggatntccnnccaaggaaacgttgctggtgacagcaaaaatgacccaccaatggaagcagctggcttcactgctcangtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgc

SEQ ID NO: 57793 - DNA, 256 bp, Homo sapiens
  misc_feature 2, 17, 34: n = A,T,C or G
tnatggaccgggggaanctcattttgtatcagangcaattttgcttgcagaaagctatgaaataaaacacgtcccttaactgcattgctatggaattaattttttttccccagggaaaactagtgtatttttttatgagcaatatcaattcggagtgaccaaaagatacttaaaaatgggtttattttgatttctcatctgaaataatcatgttctggtattatatctatctatatttaataaatatatacatttt

SEQ ID NO: 57794 - DNA, 243 bp, Homo sapiens
gtgatggctcgcctgtaatcccagcactttgggaggcagaggcgggaggattgcttgaggccaggaattcgagaccagcctgggcaacataatgagacctcatctctccaaaaaaaaagattggctagacatggtggcgtgtacctgtagtctcagctacccaggaggctgaggcatggcttttgtgagctatgattgcaccactgcactccagcctgggtgacagagtaagactccgtccct

SEQ ID NO: 57795 - DNA, 359 bp, Homo sapiens
  misc_feature 4, 11, 21, 45, 46, 55, 63, 65, 71, 73, 180, 326, 329, 351: n = A,T,C or G
cccnatgtcangctgacatcntatgtccaatgtcatagagaaagnncatagttcntgacatananattgcntnttggttactttaaaaacacaacctaaaaacaacaagagaatcaacgtctaaggatgttacagcttgacgttttgtggacattaccaatatggcatctttcagatgtnagattttggttcctatacctgacaaataaatgtcagtatttgacgtcaatgtgcctttggtttacgatgttggcttgatgttggatttaggtcactttccgacactacctaaaatcaacaaaacatcattgccatttcaagtcggnatnggacgtcaaaaaaaaacattgnccttagac

SEQ ID NO: 57796 - DNA, 238 bp, Homo sapiens
  misc_feature 3, 11, 25, 28, 35: n = A,T,C or G
aanctcggcanttttggccggggangtnaggagancaagactattcctggccaacatggtgaaaccccgtctctactaaaaatacgaaaattagcagggcttggtggcacgcgtctgtagtcccggctacttgggaggctgaagcaggagaatctcttggacccaggaggcggaggttgcagtgagccgagattgcaccactgcactccagcctgggtgacagagtgagactctgtct

SEQ ID NO: 57797 - DNA, 347 bp, Homo sapiens
gaccctgtaaacatcagaaaaaataataagggaatactgcaaactctacacacataaattacagatgaagtggaccaattcctcaaaaaacaaaagctattgcagctcatccagtttgaaatagttaatttgcctcgttttataaccactaaggatttctagttttaaaactttaaaaaaggaatattcacgtccggatggtctcacaagataattctaccaaatgtttaaagaattaacaccatttctgtacaatctctaccagaaaatagacgaaaagggaacacttcttttttgttttacaaagctggtattacactgataacaaaaccagagaaagatagttt

SEQ ID NO: 57798 - DNA, 268 bp, Homo sapiens
cgtgtggtgtattttttaaaaaatttgatttagcattcatattttccatcttattcccaattaaaagtacgcagattatttgcccaaagttgtcctcttcttcagattcagcatttgttctttgccagtctcattttcatcttcttccatggttccacagaagctttgtttcttgggcaagcagaaaaattaaattgtacctattttgtatatgtgagatgtttaaataaattgtgaaaaaaatgaaataaagcatgtttggttttcc

SEQ ID NO: 57799 - DNA, 389 bp, Homo sapiens
  misc_feature 4, 5, 60, 109, 113, 132, 168, 208: n = A,T,C or G
ctannggaaaagactggatgaatgttctcaaatgttacaaagctgtttaaagaaaaaggnatatataagtaatcggaacacttagtaagactgatagatgtcacacagnggtnttatagaaggataatacanagccaagatcaaattaaaagacaataaatggaacanaagggaggcagagtttagctttgtataaacttttaggttngctctgtaatctgctaaaccatatacattcttttgtgatatgttattatgtatgtggcacttgaggcactgtatgtaaagtgaggaatgctttactagttctccttgggtttatctttgtttaaactagctttaaagtattaaacaataattgaaatgaaaagcttacctattttaaaaag

SEQ ID NO: 57800 - DNA, 371 bp, Homo sapiens
  misc_feature 4, 36: n = A,T,C or G
ggancctctggtcctcaatcgagttcctctacgaanaacacaccagaaatttgtcattgccacttcaaccaaaatcgatatcagcaatgtaaaaatcccaaaacatcttactgatgcttacttcaagaagaagaagctgcggaagcccagacaccaggaaggtgagatcttcgacacagaaaaagagaaatatgagattacggagcagcgcaagattgatcagaaagctgtggactcacaaattttaccaaaaatcaaagctattcctcagctccagggctacctgcgatctgtgtttgctctgacgaatggaatttatcctcacaaattggtgttctaaatgtcttaagaacctaattaaatagctgact

SEQ ID NO: 57801 - DNA, 418 bp, Homo sapiens
  misc_feature 4, 26: n = A,T,C or G
gggnaggcgaataacgcaaagctganaacatggtacgttaatatcgccccactccgcgcctgggacgatttcttcccgggttccgatcgctttgcccggccggacttcagggacatttccaaatggaacaaccgcgtagtgagcaacctgctctattaccagaccaactacctggtggtggctgccatgatgatttccattgtggggtttctgagtcccttcaacatgatcctgggaggaatcgtggtggtgctggtgttcacagggtttgtgtgggcagcccacaataaagacgtccttcgccggatgaagaagcgctaccccacgacgttcgttatggtggtcatgttggcgagctatttccttatctccatgtttggaggagtccatggtctttgtgtttggcattacttttcct

SEQ ID NO: 57802 - DNA, 181 bp, Homo sapiens
  misc_feature 67, 78: n = A,T,C or G
tatggccgggggagctcagctccaaacacaggatcagcaccttgtattaggaattcccatgaattantgacttctcanttctgttttatcagagtgcatatatgtcctacttcaggaaaagtaaaacagtcatttacgaaagaaagtcaatctgtatcctaagcattttaataaaaagtta

SEQ ID NO: 57803 - DNA, 191 bp, Homo sapiens
  misc_feature 19: n = A,T,C or G
attatggcgcggggcatgnatttgtaataatcttcttcatagtaatacccatcataatcggaggctttggcaactgactagttcccctaataatcggtgcccccgatatggcgtttccccgcataaacaacataagcttctgactcttacctccctctctcctactcctgctcgcatctgctatagtggag

SEQ ID NO: 57804 - DNA, 500 bp, Homo sapiens
  misc_feature 9, 24, 51, 57, 63, 67: n = A,T,C or G
cttctttancccgggacctcggcncctattggccgggaggaaaaacaactnttactntctttnagcngtaatgcagaaatttcttcatgatcacgttgatctacaagtcagtgccctgtatgctctccaggtgcactgctataacagcaacttcccaaaaggcatgttacttcgcttttttgtgcacttctatgacatggaaattattgaagaagaagctttcttggcttggaaagaagatataacccaagagtttccgggaaaaggcaaggctttgttccaggtgaatcagtggctaacctggttagaaactgctgaagaagaagaatcagaggaagaagctgactaaagaaccagccaaagccttaaattgtgcaaaacatactgttgctatgatgtaactgcatttgacctaaccactgcgaaaattcattccgctgtaatgttttcacaatatttaaagcagaagcacgtcagttaaggatttccttctgcataag

SEQ ID NO: 57805 - DNA, 471 bp, Homo sapiens
  misc_feature 2, 22: n = A,T,C or G
tntggccggggtacccagtgcnttaatttgggcaaggaaagtgtcctaatttgatactgtatctgttttccttcaaagtatagagcttttggggaaggaaagtattgaactgggggttggtctggcctactgggctgacattaactacaattatgggaaatgcaaaagttgtttggatatggtagtgtgtggttctcttttggaatttttttcaggtgatttaataataatttaaaactactatagaaactgcagagcaaaggaagtggcttaatgatcctgaagggatttcttctgatggtagcttttgtattatcaagtaagattctatttttcagttgtgtgtaagcaagtttttttttagtgtaggagaaatacttttccattgtttaactgcaaaacaagatgttaaggtatgcttcaaaaattttgtaaattgtttattttaaacttatctgtttgtaaattgta

SEQ ID NO: 57806 - DNA, 498 bp, Homo sapiens
  misc_feature 2, 5: n = A,T,C or G
cnttntggcccggggctctttttccggctggaaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagctttcttcgccttcgtcaaatcttcaatggaacctttgtgaagctcaacaaggcttcgattaacatgctgaggatttgtagagccatatattgcattgggggggtaccccaatctgaagtcagtaaatgaact

SEQ ID NO: 57807 - DNA, 489 bp, Homo sapiens
  misc_feature 10: n = A,T,C or G
ggaagtgacntaatttacttgtttttaagaaatctgattctactaacacattcaagttcagctgttatatggtgaggactctatttagatccagctaatataccttgatgtgtaaccagataatttatccttttaaaggggtaggggttttgttgtgctgctggtttggttttttggttttaattcctattctacagaaagaagctgaagctcagcttggaggatagactcaatagtgaagagtcttgttacaatgaggtggattcagatgctgttaagagagtcttatgttgtacacgataaatacatactgtcttaatttttcagttgaaaaataaattgtaaaaatagctgggtgtgataggctcatgcctgtaatcccagcactatgggaagccgaggcgggcggatcacttgaggctaggagttcaagaccagcctggccaacatggtaaaaccccgtctctactaaaaatacacagattagct

SEQ ID NO: 57808 - DNA, 106 bp, Homo sapiens
gctcacacctgtaatcctagcactttgggaggctgaggagggtggatcacttgaggtcaggagtttgagacaagcctggccaacatggtgaagcctcatctctacc

SEQ ID NO: 57809 - DNA, 487 bp, Homo sapiens
aggatgtgattgccttctctgggattcagacaggctctgtcaatgtggagcacaaaaggagattttcatataacttgttaaaaacatgttctaagtcatgtataggctaagattttaagaagatctgggggaataaaaagccaacagtaagccccaggaaagggttttttgagaccatatgtatgctattaaaatatattgagattaatacatgaaaatgcttaaaagtgataggaattattgagaaacttatgatggtggcattgccttttataaacatggagtgaaagccatttgactcaacgtttgctgtgcttaaagaattgcttcaggacccgagcgtttttatgtatgctgttcctgcagttaggaaaaaaaaatccaagaaatgtattgaatactcaagaaaatgccacatttcaattacatatttaaaactgtatctgtaagggcttttcaaaatgtagcaagataaaaatctcttatc

SEQ ID NO: 57810 - DNA, 477 bp, Homo sapiens
  misc_feature 431: n = A,T,C or G
atttaatagtgagtatagagtaggatattctatacattttagtatttggcccttggaaacaaagttaaataccatgtcactcagaagactctcaaagtttgtgtataaatggcgaagtatgcactatgagagattctaatccattcacatcattcttgagttgtgcaaatacacttggctttgatttcacttggtgatctaaatttgtttatttaagctgcaagaaagttacattaatttggaatgtgtcatcacttggacccagtatatcagatttttattaagtaaaatgttaaaaataataagtgtaactcagattctggatgttcgagtttacaatacattgcctgtaataaaagctgattctgaagtgcatttttcttgacttactttggcagaaatatacttatatcttaatttataagtttggnaagtttatactgttttctaaaagtaataaatcatttcatgaaaaat

SEQ ID NO: 57811 - DNA, 468 bp, Homo sapiens
atagcatacaagcaagaagcttacagcctcagtggcgaaaattttttcatgtcagagaccgagaactcttgcagtcgtttatgtcatcccttcttctccagacagaagataccaaaaagttgcaatcaaagatctcttcatcttattgataaagccactaataagccaaaatgtctgtcaatgtcaaccgcagcgtgtcagaccagttctatcgctacaagatgccccgtctgattgccaaggttgagggcaaaggcaatggaatcaagacagttatagtcaacatggttgacgttgcaaaggcgcttaatcggcctccaacgtatcccaccaaatattttggttgtgagctgggagcacagacccagtttgatgttaaagaatgaccgttacattgtcaatggatctcatgaggcgaataagctgcaagacatgttggatggattcattaaaaaatttgttctctgt

SEQ ID NO: 57812 - DNA, 474 bp, Homo sapiens
gaactttcaacaaaatgtgtgcactgtggcattgtctttctggatgaagtgatgtatgctttgcatatgagttgccatggtgacagtggacctttccagtgcagcatatgccagcatctttgcacggacaaatatgacttcacaacacatatccagaggggcctgcataggaacaatgcacaagtggaaaaaaaatggaaaacctaaagagtaaaaccttagcacttagcacaattaaatagaaataggttttcttgatgggaattcaatagcttgtaatgtcttatgaagacctattaaaaaaatacttcatagagcctgccttatccaacatgaaattcccttcttttgttattctttcttttgatgagtaggttaccaagattaaaaagtgagataaatggtcaatgagaaagaatggaagatggtaaacaatcactttttaaaacctgttaagtcaaaaccatcttggct

SEQ ID NO: 57813 - DNA, 364 bp, Homo sapiens
  misc_feature 2, 3: n = A,T,C or G
anngcgggaatctcggcccttattggccgggaactcaggatgggggctgctcacaaagaccacatcatgattggaagtttcaaactttcagtctcccacctccagagaggggagaggggctggagatttgtgtcaataatccatcaggcctatgtcaacaagacataatccgttaactatggagttcagggagcttcagggttggcaaacattttgatgtgccaggaaggtgacgcactccagctttatgaagtcagcaagtcctgtgctcaggatgcttctggaccttgccccaggtaccccttcatgtggctgttgttcatctgtatcctttgtagtagccttaaaataaactgttaaacac

SEQ ID NO: 57814 - DNA, 491 bp, Homo sapiens
  misc_feature 7, 11, 25, 31, 41: n = A,T,C or G
gcagtcnaggnaagtaagaagaagnaaaagnaaaccaaagnactaaaaaagttgaaaaaactgtctgggactgggaacttatgaatgatatcaaaccaatatggcagagaccatcaaaagaagtagaagaagatgaatacaaagctttctacaaatcattttcaaaggaaagtgatgaccccatggcttatattcactttactgctgaaggggaagttaccttcaaatcaattttatttgtacccacatctgctccacgtggtctgtttgacgaatatggatctaaaaagagcgattacattaagctctatgtgcgccgtgtattcatcacagacgacttccatgatatgatgcctaaatacctcaattttgtcaagggtgtggtggactcagatgatctccccttgaatgtttcccgcgagactcttcagcaacataaactgcttaaggtgattaggaagaagcttgttcgtaaaacgctggacatgatc

SEQ ID NO: 57815 - DNA, 170 bp, Homo sapiens
tgactgccatgtgttcatcatcttaagtattgtaagctgctatgtatggatttaaaccgtaatcatatctttttcctatctgaggcactggtggaataaaaaacctgtatattttactttgttgcagatagtcttgccgcatcttggcaagttgcagagatggtggagct

SEQ ID NO: 57816 - DNA, 486 bp, Homo sapiens
tatggccgggggtataaaggtgttttcattttcctgttcttacctattattgtatagagctattcatgccattttttgggaaaactttaaaaattgccccaaatactgacattgagtgcattaaataacaaattatctttgatacattaaacttttattcttcatgcatctgtaatttaattttaagtataatgttttgcctttggtacaactaaattaaaactcttggtggtcacatattgtatataaacaaaacaatatgctttgttgaaggaaaattttctttattggaatgtggttgtaatccttgttcagttcttaagtttcggtttttttaaaaacaggatgcaacttaaacttttctttgcatcaaggtatatgcaaaacattggtgccgcgcatcaccaaatgaaagtttgtatttaacgaggaggtgctttacactgtactttttggtggttttttggaaaaagttacatttagatc

SEQ ID NO: 57817 - DNA, 500 bp, Homo sapiens
  misc_feature 13, 16: n = A,T,C or G
tggcccgggaagntancgccatgccgcccaacttcctctttttccggctggaaccatggagggtgtagaagagaagaagaaggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatggggggtaccccaatctgaag

SEQ ID NO: 57818 - DNA, 301 bp, Homo sapiens
catggaaaggacattttttagcaatttataattttaaaatggaatttgccaaacaagggagaggaaaaaaagtcaaaggggaatttttatctcaagatatttagatatggtttataaaaaaataatattttctaccactaaaaacactggtattatctcagcatcatgggcaatttttctttattacatgccaatatttgtacaaaaaaggcccccaaatgtgtgaaatataatcctaaaaaagaaaataattggaacacatggatctgttacaattctacacagggggaaacaagctaag

SEQ ID NO: 57819 - DNA, 497 bp, Homo sapiens
  misc_feature 1, 10, 39: n = A,T,C or G
naattcggcnttatggccggaactcacagcttctccagncatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatgggggggtgatta

SEQ ID NO: 57820 - DNA, 100 bp, Homo sapiens
  misc_feature 15, 22, 31, 38, 46: n = A,T,C or G
tacacgcagggcaanctcggcntttatggcncgggggnttctattntacgacactatttatccagattgctgctcgctgccctagtgccgcgcaaagatg

SEQ ID NO: 57821 - DNA, 471 bp, Homo sapiens; identical to SEQ ID NO: 24804

SEQ ID NO: 57822 - DNA, 500 bp, Homo sapiens
  misc_feature 7, 8, 28, 31, 36, 37, 64: n = A,T,C or G
tggccgnnaaacccctatgagtcccagnagnagaanntaattttatacgttgataaaacttatnaatttcattgattaatctcctggaagattggtttaaaaagaaaagtgtaatgcaagaatttaaagaaatatttttaaagccacaattattttaatattggatatcaactgcttgtaaaggtgctcctcttttttcttgtcattgctggtcaagattactaatatttgggaaggctttaaagacgcatgttatggtgctaatgtactttcacttttaaactctagatcagaattgttgacttgcattcagaacataaatgcacaaaatctgtacatgtctcccatcagaaagattcattggcatgccacaggggattctcccccttcatcctgtaaaggtcaacaataaaaaccaaattatggggctgcttttgtcacactagcatagagaatgtgttgaaatttaactttgtaagcttgtatgtggttgttgatct

SEQ ID NO: 57823 - DNA, 457 bp, Homo sapiens
ggagagcaagcagcgagtcttgaagctctgtttggtgctttggatccatttccatcggtccttacagccgctcgtcagactccagcagccaagatggtgaagcagatcgagagcaagactgcttttcaggaagccttggacgctgcaggtgataaacttgtagtagttgacttctcagccacgtggtgtgggccttgcaaaatgatcaagcctttctttcattccctctctgaaaagtattccaacgtgatattccttgaagtagatgtggatgactgtcaggatgttgcttcagagtgtgaagtcaaatgcatgccaacattccagttttttaagaagggacaaaaggtgggtgaattttctggagccaataaggaaaagcttgaagccaccattaatgaattagtctaatcatgttttctgaaaacataaccagccattggctatttaaaacttg

SEQ ID NO: 57824 - DNA, 484 bp, Homo sapiens
  misc_feature 21, 483: n = A,T,C or G
ggaaccacctcaatgcaaagnattctacaggaaaatgtgggccccctccacctattgacaatggggacattacttcattcccgttgtcagtatatgctccagcttcatcagttgagtaccaatgccagaacttgtatcaacttgagggtaacaagcgaataacatgtagaaatggacaatggtcagaaccaccaaaatgcttacatccgtgtgtaatatcccgagaaattatggaaaattataacatagcattaaggtggacagccaaacagaagctttattcgagaacaggtgaatcagttgaatttgtgtgtaaacggggatatcgtctttcatcacgttctcacacattgcgaacaacatgttgggatgggaaactggagtatccaacttgtgcaaaaagatagaatcaatcataaagtgcacacctttattcagaactttagtattaaatcagttctcaatttcattttttatgtattng

SEQ ID NO: 57825 - DNA, 492 bp, Homo sapiens
  misc_feature 11, 15, 29, 41, 130, 164: n = A,T,C or G
accggggggangtantatcggcaggtggnggcggcggaggntttggcagctcgggactgagtgcaagtaatcagcatgattcttcagaggctcttcaggttctcctctgtcattcggtcagccgtctcantccatttgcggaggaacattggtgttacagcagnggcatttaataaggaacttgatcctatacagaaactctttgtggacaagattagagaatacaaatctaagcgacagacatctggaggacctgttgatgctagttcagagtatcagcaagagctggagagggagctttttaagctcaagcaaatgtttggtaatgcagacatgaatacatttcccaccttcaaatttgaagatcccaaatttgaagtcatcgaaaaaccccaggcctgaagaaataaagtaaaattaatctggtaatttgtcacggattagttgtacaactagttagaagtttcagaataaacatgcatttcataactg

SEQ ID NO: 57826 - DNA, 305 bp, Homo sapiens
acaggccttgaacttcatggcatatcaactttgccatatctgcaggagagctgttctataagaaatagctcagagttgcaaatatcacatgtgaatgatacggtaacttttaagaaatgtctgtattgtatttgaagactgtttgccataaatctgaaatttgaacctatgtatttcaatttggtatgctaaaaagttctgaattaatgtaaagttttttgttataatattgtaatctcagttcaaaagttaactgcaaatataaaacccaatgatttctatatagtaaattgaactgtaaagat

SEQ ID NO: 57827 - DNA, 467 bp, Homo sapiens
gagctgtgaaaggaggagctctacggtgactttgaagacttggaaacaggggacatgcacaagggaaaatcgggccccgacactcagaatgaagatatagagaaacaaggaagaaattgaccccgacgaagaagaaagtgccaagaaaaagcatttggataagaagagaaaattgaaggagatgtttgatgcggaatatgatgaaggagaaagcacatattttgatgatcttaaaggagaaatgcagaaagaagcacagttgaatcacgtagaatttgaagatcaagatgatgaagccagagttcagtatgatggttttcgacctgggatgtacgtccgcgttgagattgaaaatgttccctgtgaatttgtgcagaactttgacccccattaccccattatcctgggtggcttgggcaacagcgagggaaatgttggacacgtgcagatgcgtctgaagaaacatc

SEQ ID NO: 57828 - DNA, 108 bp, Homo sapiens
atccgtaaatctactaaagaaattggattcataatataaaaaacctttccctcaaagaaaactccagccccagatagtttaattggtgagttctgccaaacatttaag

SEQ ID NO: 57829 - DNA, 464 bp, Homo sapiens
  misc_feature 139: n = A,T,C or G
gggggcaaacccaggcaacatggtacttagcccagaggggaagatcaggaatctttgcttcagcctgatcagcctagtcctgagttcccatttcagtatgatccttcctacaggtcagtccaggaaattcgagagcatnttagggccaaggagagtacagagcctgagagttcatcctgtaactgcatacaatgtgagctgaaaattggttctgaagagtttgaagaactccttttattaatggaaaaaaattcgggatccttttattcatgaaatatctaaaatcgcaatgggtatgagaagtgcttctcaatttacccgagatttcattcgagattcaggtgttgtctcacttattgaaaccttgcttaattatccgtcctcccgagttagaacaagttttttggaaaatatgattcgcatggccccaccttatccgaatctaaacataattcagacataca

SEQ ID NO: 57830 - DNA, 473 bp, Homo sapiens
gtgttgcagcattttaaagcttttagaagaacttttaagagaaagtttaaaatcctaaaagaaagttgggtaactgattcaatagacaagtgtgaattacaagaagaaaaccagtatttgatttaaagctaggtttcctagtgaggaaagcctctgatctggcagactcattgcagcaggtggtaatgataaaatactaaactacattttatttttgtatcttaaaaatctatgcctaaaaagtatcattacatataggaaaacaataattttaacttttaaggttgaaaagacaatagcccaaagccaagaaagaaaaattatcttgaatgtagtattcaatgattttttatgatcaaggtgaaataaacagtctaaagaagaggtgtttttataatatccatatagaaatctagaatttttacttagatactaataaaatacatttagaaacttttaaagtcatgaaaaag

SEQ ID NO: 57831 - DNA, 232 bp, Homo sapiens
  misc_feature 230: n = A,T,C or G
ggggtagactgctcctgcagagtttggaagaagtcaccagcaaagccggcctaaccaagaaaagtcaaggcccttcatgaccttgctgggcacagaaaacaccctcgtggagtacactaatttgaactggactggtctcagtgtgagcacttggcacactttactaaacacatatacaaccccaccgtgagtcaactttaaagtaaacattaaagattcttgtgatacantc

SEQ ID NO: 57832 - DNA, 263 bp, Homo sapiens
  misc_feature 15, 16, 43: n = A,T,C or G
gcgggcaattcggcnnttatggcccgggatttggatgattgtnataaggtttttagcatgttcctccttttcttcaccctccccttttttcttctattaatcaagagaaacttcaaagttaatgggatggtcggatctcacaggctgagaactcgttcacctccaagcatttcatgaaaaagctgcttcttattaatcatacaaactctcaccatgatgtgaagagtttcacaaatccttcaaaataaaaagtaatgacttag

SEQ ID NO: 57833 - DNA, 399 bp, Homo sapiens
  misc_feature 19: n = A,T,C or G
ggcaacgggtgactggaanggcctgaggattacagtgaaactgaccattcagaacagacaggcccagattgaggtggtgccttctgcctctgccctgatcatcaaagccctcaaggaaccaccaagagacagaaagaaacagaaaaacattaaacacagtgggaatatcacttttgatgagattgtcaacattgctcgacagatgcggcaccgatccttagccagagaactctctggaaccattaaagagatcctggggactgcccagtcagtgggctgtaatgttgatggccgccatcctcatgacatcatcgatgacatcaacagtggtgctgtggaatgcccagccagttaagcacaaaggaaaacatttcaataaaggatcatttgacaactggc

SEQ ID NO: 57834 - DNA, 486 bp, Homo sapiens
gtatgagttaaatgtactgaacttatttttcttactcctctgtgaaacagtcttaattaactaatgtagtaagcagctttctaaccttcaaaatgattttctgtggtagcaaaatcattttgcaagtcaaatgcaacactagtttatcttttgcatttgaaggactgtttaactattaactggttaattgtgtatcattcccatacagaaggtaagtactcaaattattttcctcataaaacctgacattcagcatcttaaaggtaggtatacattttggtactttcttatgttcactcctatacccactagatcaaaaatataaggtactgagtgattttaaaacttaaatgaaaaattttaataaggaaaaagtaatagacaatatcagtatgataaagtgggatctacaccagttatcagagaaacacaaatgtgtacatactgcatgatctgcaaagtgtagccacatataatattttgcat

SEQ ID NO: 57835 - DNA, 478 bp, Homo sapiens
gaggatagtttagaataatagaacttgattttgtgtattatagcggcaacatttgcgctgctttagttagggttgtgtcagcacttccattataaacccctgttttcagggggtataactagggagatttttttttaatacaaattaaaaaaacaattcatttgaatgatttttaagttataatagtgcaaaaataaaacaaagtaaagtcacatcgaaattgaccatttccacaaggattttgattttcttttacttattagtcatataaggcagcagctaaagtaaggtgctgttttaatatgttggggatgaaaatttttgcaatggaaaattactgactgagcattaaaataaatgtaagcattccacatgacattttaaaacactgaaacatgggtatatttgatttatggagtttctaaaggagagtaactatggacagtggttatagtaaaggcattaccaaaagtcaagt

SEQ ID NO: 57836 - DNA, 496 bp, Homo sapiens
  misc_feature 1, 18, 486: n = A,T,C or G
nccgggacattccctagnatgaaaatggctctcgccttccagcaattccccgcagtactacaaatgggaagtcagagaccatcacagctgatgtcaatcacaacttgaaggatgccaatgatgtaccaatccaatgtgaaatctctcctcttatctcctatgctggagaaggattagaaagttatgtggcagataaagaattccatgcacctctaatcatcgatgagaatggagttcatgagctggtgaaaaatggtatttgaaccagataccaagttttgtttgccacgataggaatagcttttatttttgatagaccaactgtgaacctacaagacgtcttggacaactgaagtttaaatatccacagggttttattttgcttgttgaactcttagagctattgcaaacttcccaagatccagatgactgaatttcagatagcatttttatgattcccaactcattgaaggtcttatttatatnaattttttcc

SEQ ID NO: 57837 - DNA, 154 bp, Homo sapiens
ggtggcccacttgggcaccccacgccttctgtccacttctggttgccaggagacagcaagcaaagccagcaggacatgaagttgctattaaatggacttcgtgatttttgttttgcactaaagtttctgtgatttaacaataaaattctgttag

SEQ ID NO: 57838 - DNA, 482 bp, Homo sapiens
ggaggaaatggctcgtcaccttcgtgaataccaagacctgctcaatgttaagatggcccttgacattgagattgccacctacaggaagctgctggaaggcgaggagagcaggatttctctgcctcttccaaacttttcctccctgaacctgagggaaactaatctggattcactccctctggttgatacccactcaaaaaggacacttctgattaagacggttgaaactagagatggacaggttatcaacgaaacttctcagcatcacgatgaccttgaataaaaattgcacacactcagtgcagcaatatattaccagcaagaataaaaaagaaatccatatcttaaagaaacagctttcaagtgcctttctgcagtttttcaggagcgcaagatagatttggaataggaataagctctagttcttaacaaccgacactcctacaagatttagaaaaaagtttacaacataatctagttta

SEQ ID NO: 57839 - DNA, 480 bp, Homo sapiens
ccttatggccgggcgacccaaggaatttgaaggtgttcatgagctgaagaaattaaacctcagcagcaatggcattgaattcatcgatcctgccgctttttttagggctcacacatttagaagaattagatttatcaaacaacagtctgcaaaactttgactatggcgtattagaagacttgtattttttgaaactcttgtggctcagagataacccttggagatgtgactacaacattcactacctctactactggttaaagcaccactacaatgtccattttaatggcctggaatgcaaaacgcctgaagaatacaaaggatggtctgtgggaaaatatatttagaagttactatgaagaatgccccaaagacaagttaccagcatatcctgagtcatttgaccaagacacagaagatgatgaatgggaaaaaaacatagagatcacaccgcaaagaagcaaagcgtaataattacta

SEQ ID NO: 57840 - DNA, 464 bp, Homo sapiens
gcttccttttcgatccgccatctgcggtggagccgccaccaaaatgcagattttcgtgaaaacccttacggggaagaccatcaccctcgaggttgaaccctcggatacgatagaaaatgtaaaggccaagatccaggataaggaaggaattcctcctgatcagcagagactgatctttgcaggcaagcagctggaagatggacgtactttgtctgactacaatattcaaaaggagtctactcttcatcttgtgttgagacttcgtggtggtgctaagaaaaggaagaagaagtcttacaccactcccaagaagaataagcacaagagaaagaaggttaagctggctgtcctgaaatattataaggtgggatgaagaatggcaaaattagtcgccttcgtcgagagtgcccttctgatgaatgtggtgctggggtgtttatggcaagtcactttgacagacatta

SEQ ID NO: 57841 - DNA, 187 bp, Homo sapiens
  misc_feature 12, 26: n = A,T,C or G
gcgatcttggantgttctcttggccntttgatgaaatactacaatgcagaatggttatgattttcaaactgcaaatagtttagccccacattttggcaagatatctaggcagagctcacagaagaagctgcttattcaggcttcagccaagctgtgaaaagtgaggccttttgagaggaagtgagat

SEQ ID NO: 57842 - DNA, 480 bp, Homo sapiens
atatgaagtgggtagtactatttctgcttttcagaagaaaaaacaggcatagagaaatgaggttgcttgctcaaggtacctgagttagttaagtgttagggccaggacttgaatccaaccagtgtgactctagagccagtactattgatcattatatggtaaaattgtaaacaacctaaatgtttcacagtgattgttagggtccatccctacagtggggtactgccttctcagccatgaaaatgatgatagaataatataaagacatgaaaggatgtcttggtatatgtaagtgagaaaaaataaatttaaaaacatgattccattttggtaaaaaaacccaaaaatatattatgtcttggaaggatatgtgccaaattgttaaatggttatttctgagtgtagttttacaggtgattgttttctttttgcttatccaaattttctaacttctacaatgaatataaattatctatcatg

SEQ ID NO: 57843 - DNA, 471 bp, Homo sapiens
  misc_feature 5: n = A,T,C or G
tgcanaaagtattctgaactgtcaagctgcccagtcagatgggctgttgccatttaaaatcactgtaattaattagtttgattagagcacaaagcttagctaatcaaccattatttttcattttgtttgttctaagaggattgaaaatcagtttagtttaaatgtctttctgttaggcctttctttcttacaatgaagagatgattcttctagtttatggttaaaagtttttgaagtgtctcaaaaatattttactaactgtaaccctaaaattgatgtcttttggtttatgaaatcagtaatttttgatatttccccagttctttttaatggggtcaataatggacattctagtttaaggtggttgatggatttagccatatatgctgctaaagaaattgtctaccttttcttcctcacctgttccatttatgtaaagttgagattaggggggaaagcattttctatatc

SEQ ID NO: 57844 - DNA, 482 bp, Homo sapiens
agtggcagcgctttcaacagctaaatataagaactggcctgaatctgtgtattttttcaagagaggtggcagcattcagcagtatatttataaacaggaacctgtacagaagtgccctggaagaaggcctgctctaaattatccagtgtatggagaaacgacacaggttaggagacgtcgctttgaacgtgctataggaccttctcaaacacacaccatcagaattcaatgttcacctgccagactggcttatcaagacaaaggtgtccttcataatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtc

SEQ ID NO: 57845 - DNA, 203 bp, Homo sapiens
  misc_feature 9, 13, 114, 132: n = A,T,C or G
accgggaantcgncttaggccgggggcgtcgtagtctcctgcagcgtctggggtttccgttgcagtcctcggaaccaggacctcggcgtggcctagcgagttatggcgacgaangccgtgtgcgtgctgaanggcgacggcccagtgcagggcatcatcaatttcgagcagaaggaaagtaatggaccagtgaaggtgtgggg

SEQ ID NO: 57846 - DNA, 476 bp, Homo sapiens
gtggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtagggtgattaaaataatttggaaggcgatcttttaaaaagagattaaaccgaaggtgat

SEQ ID NO: 57847 - DNA, 307 bp, Homo sapiens
ggtgctgtgcaaatgattttgcagttttgaagatgataaaactagattgtaagtggggttcagtgaggacattcatcagacacgtaagaggtgctgcaatcagggtgatgcccatcttactcatccttggctgcccttggtccgacacctctctatacaagactggttctcagtattttaaatggtacagaattctttttaaaaagtagagagattttgaaaagcataaaaatcatgcctttataatcttagcagccatcagatacaccttgatttatgtagtagtaaatataacaaatattttaat

SEQ ID NO: 57848 - DNA, 194 bp, Homo sapiens
  misc_feature 5, 13: n = A,T,C or G
atggnccgggaangttactgacagtgttaccagccgtctggaattcttggtccctccgtggagaaactcttcagatggtcattgtgtacctactctctcttcaaaggaagttgtgatcaagttcaactttttgtgctaacaatgcatgcaggactaagagggatgatctaaaaaataaataatgtaatttaaac

SEQ ID NO: 57849 - DNA, 155 bp, Homo sapiens
ggcggcgacgacccattcgaacgtctgccctatcaactttcgatggtagtcgccgtgcctaccatggtgaccacgggtgacggggaatcagggttcgattccggagagggagcctgagaaacggctaccacatccaaggaaggcagcaggcgcac

SEQ ID NO: 57850 - DNA, 465 bp, Homo sapiens
  misc_feature 23: n = A,T,C or G
gtatgaatggatttattgaccgnattgatggaatagttcattttgaaacacgagaagccctgccaacgtgggataagcagatccaatcactttgtttccaagtgaataaccttttggagaaaattagtcaaacagcaccagaatggacagcacaagccatggaagcccagatggctcagtgaatccttgcagaacttctgtgcacatgacatctttttccatgttgtgcagatcagtttcactatctccaaagcatttgcatcatgaccttatacatttcaatcccttttatgctggattccgtttaaagaagacattattagagcaggaagtacaaacatttaaaatatggtagttcccatatatttcagggtctctgtgtattaagctaactcagatgttttgaaagctttttctttaaacagaggtgaaatatctgtggctaaaaagtttgagatttggtga

SEQ ID NO: 57851 - DNA, 462 bp, Homo sapiens
  misc_feature 351, 460: n = A,T,C or G
ggagcagagggagatacagaaaccgacaggggccaggcgcccggtggctccgaagcggggaagtgggacaagatggtttacatctcgaacggacaagtgttggacagccggagtcagtctccatggagattatctttgataacagatttcttctggggaatagctgagtttgtggttttgtttttcaaaactctgcttcagcaagatgtgaaaaaaagaagaagctatggaaactcatctgattccagatatgatgatggaaagagggccaccaggaaaccctccccgaagaatgggtagaatcaatcatctgcgtggccctagtccccctccaatggctggtggatgaangaaggtaaatgtctgctctaagaagcagacaaccggacatgcgcattcatagcagaaggaaaccatcaagaagtggaaggctgaccatgatgagcagtagatgaatgtngt

SEQ ID NO: 57852 - DNA, 365 bp, Homo sapiens
aacaggtgaatggataaacaagctctggtatagtcatacaacagactactactcaagaataagaactgctgcatacaacagtgtggatgaatctcaaaggcactgtgttgagtgacagaagccagtctcaaaaggttacatactaaaagattctatgtatatgatattctggaaaaggcaaagttatagggatagagagtagatcagcgattgtgaggaggtgggggttaaagaaggattttactacaaaggtgcaatgcaaggaagttttgggggtgatgaactgtcctgtatcccgattgtggtggcagttacatgaatctatatttgtgttaagatctatagatctgtactccctcaaaaag

SEQ ID NO: 57853 - DNA, 472 bp, Homo sapiens
gataaacaaaccctgagagtatacaaaagaaaccatgcaaagcaacgactactttgctacgaagaaagactcctttcctgcatctttcatagttctgttaaatatttttgtacatcgcttctttttcaaaactagttcttaggaacagactcgatgcaagtgtttctgttctgggaggtattggagggaaaaaacaagcaggatggctggaacactgtactgaggaatgaatagaaaggcttccagatgtctaaaagattctttaaactactgaactgttacctaggttaacaaccccgttgagtatttgcttgtttgtccagttcaggaatttttgttttggttttgtctatatgtgcggcttttcagaagaaatttaatcagtgtgacagaaaaaaaaatgttttatggtagctttttacttttttatgaaaaaaaaattatttgccttttaaattcttttcccccatcc

SEQ ID NO: 57854 - DNA, 430 bp, Homo sapiens
  misc_feature 3, 33, 429: n = A,T,C or G
aanagccccgtttttcctttagtcaggaaggtngttggtgttgaggttagcatacgtatcaaggacagtaactaccatggctcccgaagttttgccaaaacctcggatgcgtggccttctggccaggcgtctgcgaaatcatatggctgtagcattcgtgctatccctgggggttgcagctttgtataagtttcgtgtggctgatcaaagaaagaaggcatacgcagatttctacagaaactacgatgtcatgaaagattttgaggagatgaggaaggctggtatctttcagagtgtaaagtaatcttggaatataaagaatttcttcaggttgaattacctagaagtttgtcactgacttgtgttcctgaactatgacacatgaatatgtgggctaagaaatagttcctcttgataaataaacaattnc

SEQ ID NO: 57855 - DNA, 175 bp, Homo sapiens
ggtgtgagtcaaatgccccctgagtgactgcccccagcccaggccagaagacctcccttcaggtgccgggcgcaggaactgtgtgtgtcctacacaatggtgctattctgtgtcaaacacctctgtattttttaaaacatcaattgatattaaaaatgaaaagattattggaaag

SEQ ID NO: 57856 - DNA, 330 bp, Homo sapiens
  misc_feature 327: n = A,T,C or G
ctgagtttcagaaaaaataactttctcatggccccacaggttcttccagtggggagataggtcccagtccaatcagacttcacagactaggagaagggcatgtcaaaggagaacagattgaaggacacaatttgtacctagtagataagacagagagttaataatattagtaatgtatacgcaactcagatcaaacagaggttctcaaataggcaagtaaacaaaggctcatttcacatatgggtaatggtaaataatatgcatttgcaagggaaatattcaaattggttagtaatttttaaattgctcaaaccagtaaaggtgatnttg

SEQ ID NO: 57857 - DNA, 211 bp, Homo sapiens
gttgtaaaatgctagtataaacaaacaaattaatgttgttctaaaggctgttaaaaaaaagatgaggactcagaagttcaagctaaatattgtttacattttctggtactctgtgaaagaagagaaaagggagtcatgcattttgctttggacacagtgttttatcacctgttcatttgaagaaaaataataaagtcagaagttcaagtgc

SEQ ID NO: 57858 - DNA, 465 bp, Homo sapiens
gagttttataaagggagagagcaagcagcgagtcttgaagctctgtttggtgctttggatccatttccatcggtccttacagccgctcgtcagactccagcagccaagatggtgaagcagatcgagagcaagactgcttttcaggaagccttggacgctgcaggtgataaacttgtagtagttgacttctcagccacgtggtgtgggccttgcaaaatgatcaagcctttctttcattccctctctgaaaagtattccaacgtgatattccttgaagtagatgttggatgactgtcaggatgttgcttcagagtgtgaagtcaaatgcatgccaacattccagttttttaagaagggacaaaaggtgggtgaattttctggagccaataaggaaaagcttgaagccaccattaatgaattagtctaatcatgttttctgaaaatataaccagccattggctattt

SEQ ID NO: 57859 - DNA, 474 bp, Homo sapiens
aactattaaagacataattaaataaagaggtataccatagtcattgagcagaaaattccatatttttaagatacttctcaccacattcatctatagtgttaatgccgtcatgatcagtgccaaacaggcttaagaaaatgacacactatttctgaaatttatgtaaaaatgcagaggactaagatagccaaaataattttttaaaaagaaaaatgttgaagaacttacactactagatttagtacaaatctaaagaattaagataggtatgatgttggcaaaagaactaataaattgaataataggacaaaatataaagtccagaaattgactcatacatatacagtcaacacacataccgtcaattgatttttctatggagagtgctaaggtcattcgatttgaggaaataaggcatttttacaaatgtgtagggaaaaagaaatttatttttaaaaagaacttcaacctcta

SEQ ID NO: 57860 - DNA, 334 bp, Homo sapiens
  misc_feature 28: n = A,T,C or G
tagatgatagcagataaaacaccaaagncaaaggatatgagctatttaggaattgattatataagatgatttgttagaaacaaatttcaaggcccttttaactttaatatttttgtttaggattttaagtatctacatttaggtattaaatgtttatcatttttgttgtttcttaatagaattatttgtttttagtttttcttagctatgattaaaatttttaaatgtagactacaagtggttgttacccattcaatgactattaaactttagtttttcatcaataaggtgatgacttcactatttctatgtgttttttttttttaaaggttat

SEQ ID NO: 57861 - DNA, 301 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtattt

SEQ ID NO: 57862 - DNA, 497 bp, Homo sapiens
  misc_feature 6, 17, 102, 106, 112, 488: n = A,T,C or G
gctctngcccagggacntcggctcttatggcccggcccttaaaaactttatttataaaaaggaaaagtagttttcatattaagtttttatttcctttccagnagtnggggcnagaaagtatgtgttggcactagaaacattgtcaagatttgttctgtggtgtaggtatgcacattccataggtatgcacacagccatgtaatatcagtatatcccaagttaatgaaagtgttcatttacataggtaatggagacctttgcattttgatccatagaacataggaggatgttcttagtctgtctcaaagctctatatgtttacatattatttctgtagattgttttcaggagaaagttttgcttctatggtaagagtgagcactttggcttatgtataagttagaaataattgttagtttttaatatgcacttcgtggggaaatttcttagacgtatgcaagcaagtgaaaacaattagggccagtggnattaactac

SEQ ID NO: 57863 - DNA, 339 bp, Homo sapiens
  misc_feature 14: n = A,T,C or G
gtcctgttgaaatnagtaattaaacatttaagagcccaaaattgtatcacttttataatattttgcagtaaaatataataccatcttctctgttaatacataattgctccaagcttcctgtaaactataagaatatatttagtttacagtatatggattctatgaaaaaatgtccacaacacagtaattggtcacttgttaagaaaaatttatccttgtaagtatcttcaaagttgatatttggaactttattccaaaagtagtgcatgtggagaaagaatctagactttcttgtatacatttttctcttctccagtaataaacaattacctttcattt

SEQ ID NO: 57864 - DNA, 252 bp, Homo sapiens
  misc_feature 11: n = A,T,C or G
acacacatagnaactccaacaacatcaatttcattgcacagactgactgtagttaattttgtcacagaatctatggactgaatctaatgcttccaaaaatgttgtttgtttgcaaatatcaaacattgttatgcaagaaattattaattacaaaatgaagatttataccattgtggtttaagctgtactgaactaaatctgtggaatgcattgtgaactgtaaaagcaaagtatcaataaagcttatagact

SEQ ID NO: 57865 - DNA, 230 bp, Homo sapiens
gaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaagg

SEQ ID NO: 57866 - DNA, 308 bp, Homo sapiens
  misc_feature 5, 6, 122, 123: n = A,T,C or G
tcggnnctttatggcccgggggaagaaagagattttaaacaaaaatcgatctaaaaaaattcagaagaaatatgatgaaaggaaaaagaatgccaaaatcagcagtctcctggaggagcagnnccagcagggcaagcttcttgcgtgcatcgcttcaaggccgggacagtgtggccgagcagatgactatgtgctagagggcaaagagttggagttctatcttaggaaaatcaaggcccgcaaaggcaaataaatccttgttttgtcttcacccatgtaataaaggtgtttattgttttgttcccaca

SEQ ID NO: 57867 - DNA, 243 bp, Homo sapiens
  misc_feature 243: n = A,T,C or G
gaaggctgaggcgggtggatcatctgaggtcaggagttcaagaccagcctgaccaacacggtgaaaatctatctctactgaaaactcaaaaattagccaggcgtggtgacgcgtagctgtaatcccaactgcttgggaggctgaggcaggagaatcacttgaacctgggaggcggaggttgcagtgagctgagatcacaccactacactccagcctgggagacagagcgagactccatctcan

SEQ ID NO: 57868 - DNA, 153 bp, Homo sapiens
ggcttgatgcggggcgggtaaagggtattttaacttaggggtagttcctgctgtgagtggttacagctgatcctcgggaagaacaaagctaaagctgccttttgtctgttattttattttcttgaagtttaaataaagtttactaattttgac

SEQ ID NO: 57869 - DNA, 261 bp, Homo sapiens
  misc_feature 217, 223: n = A,T,C or G
ggggtgaggccccggtcttcctcctcgtcctgccgcagggccagaacccctgacggtattcagctgcgcgtaagtctggccggtgccatctgtctccgcaatgccccccaagaaacaggctcaggccgggggcagcaaaaaggcggagcaaaaaaagaaggagaagattatcgaagacaaaactttcggtttgaagaataagaaaggagcaaagcancagaantttatcaaggctgtcacacatcaagttaaatttggtca

SEQ ID NO: 57870 - DNA, 490 bp, Homo sapiens
  misc_feature 9, 10: n = A,T,C or G
atctaaaannaatcttattaggtatttgaactctaaaactaacagataagacagatatgtaccttattagagcaccagaactaatttgctaagtcttttgtttagtcctgcaagactgatgcttaatacacagtctgttctcctgtgtctaggtcaggaactccagtttgcttttctgttttgtgtcctggtagcagctgttgagtaactttcattggaggttgggaaggaagtgaggagaaagtgttcttgtttagtgttttatttcctataataggatgctgcctaacccagttcatctctatgtcctgttcactgaatattccgggtaattgaaagaaaatataatggatgggctccattaaaaccagctcaaaaataaattcttgtcagtaaagatttcttgtcaagatgtcttggattgcacttttgttgaggaaagacagtgtaaatagttaaagaatgttgataaaattgaaacatttggttg

SEQ ID NO: 57871 - DNA, 250 bp, Homo sapiens
ggggtggggggtgatcaccaggggcacctagggagatccccttcccaccctctctgttggcctcagagtcactcctgccccctctccctgacttggtgctcacatgcacctcactagggtttgtgaccagggtctggatgagcttgaatttgaatgaattgagtttgtatttctagaaccctgggtttttacatgtttggtctttttttgttttggtttgtcaccctcgataaaggaagtatattcatcc

SEQ ID NO: 57872 - DNA, 385 bp, Homo sapiens
  misc_feature 50: n = A,T,C or G
tatggccggggtgatttccagactttttaggcatgaaattcggacacttnagtatttccaggaatagcatatgcacgctgttcttgcttcatggaatgctacatgctttctgtttttctcattttggatttctccaaaactaactgaatttaagcttcaggtccctttgtatgcagtagaaaggaattattaaaaacaccaccaaagaaaataaatatatcctacttgaaatttactctatggacttacccactgctagaataaatgtatcaaatcttatttgtaaattctcaattttgatatatatatgtatatatgcatatacatatccacacttgtctgcaagaatattgattaaaattgctaaatttgtacttgttcacca

SEQ ID NO: 57873 - DNA, 406 bp, Homo sapiens
gatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattc

SEQ ID NO: 57874 - DNA, 472 bp, Homo sapiens
gatatcaaaacatgtaaacgctcaccttaaaccaaatgttatttggtcatgaggcaccttgctggagtctcagattccaaaagtctcttcttcagactgggtagggaatatgatattttagggacaaagctgaggactggttttaaataggctttaaaataaaagatcaatattatcataatgctatcattctgctaaacggccccaaaacagtagaatttctgctcatgtcctagcaggttcagaagactgcagccaagttcagatgtaaaaacaagaagtagcacttttccaaaggaaaacaacaaaacaaatgggaaaaagataatggaccgcatttcacctattttaatactattttaacaattttttcatctaccaatatatccccaataaataaatataaaaggggggggagggtcaatctggggaatcttagttttttatgttttaagaaaacaaaaaaaactgc

SEQ ID NO: 57875 - DNA, 466 bp, Homo sapiens
gaggcattgaggcagccagcgcaggggcttctgctgagggggcaggcggagcttgaggaaaccgcagataagtttttttctctttgaaagatagagattaatacaactacttaaaaaatatagccaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccg

SEQ ID NO: 57876 - DNA, 129 bp, Homo sapiens
  misc_feature 7, 13: n = A,T,C or G
cggaggnttgatnagagcattgtgcaatacagtttcattaactccttccctcgctcccccaaaaatttgaatttttttttcaacactcttacacctgttatggaaaatgtcaacctttgtaagaaaacc

SEQ ID NO: 57877 - DNA, 239 bp, Homo sapiens
  misc_feature 6: n = A,T,C or G
cggttntttatggaccggggtatctgacaggtacagaaagtgtgtgcagcggattaaagctaaagacatagttcctggtgatattgtagaaattgctgttggtgacaaagttcctgctgatataaggttaacttccatcaaatctaccacactaagagttgaccagtcaattctcacaggtgaatctgtctctgtcatcaagcacactgatcccgtccctgacccacgagctgtcaacc

SEQ ID NO: 57878 - DNA, 487 bp, Homo sapiens
gtgtgataaaataggaacaacatagcaaatggattgatggggtgatctgagttattgtatataaaagtttttaaagaatagaatgaacatcaagctagataggcaaaaattgacacattcagaacagcttttttgactgcgaagccaaaagttgtcagaaacagcaaaagatcccttattattacagagtattttacgtagtctctattttaaggagagaaattaaatagaagggcttcatgcatttaggggagggtgctaaaacttctcaagttcgtcaaacttacaggaatacccaccatgatcattttctctctaattatgtataccacaaaattttcatctggccataggaattcactggtgggtgtaaaattaatgactaaagaaattaagtgacaaatacataaaagaaacagacttgtggggatattgttttaaggtgtattaattactcagtgatgataccactcaatagggcatgcca

SEQ ID NO: 57879 - DNA, 459 bp, Homo sapiens
  misc_feature 5, 17: n = A,T,C or G
agtgncatgttacccanttaggcttgtcaggttagtaataaactgaacagtaataaaactgtggaagtaattggatctgaatttatgaaagacccatttccaggactgaacctaggtcagagctctaaattggtccttctatttttcaacaaatttaaagtaatatttctttctaatataatattgcatcctttgtgggaatgactataggtaaaatgtagtaagtaacgcagaaccagggttggctttatttaaaagctagtgacctaaatagaaagcgaacttcaagagaagttgtaagtacagtggcaaatgcttattacttacttcaaactgtttcccaaaaataagtgcatttattttgacaataaaacttaaggctgttcatgagaaggccttgaaaagttactctagaggaaaaatgtctaaagaaaaaaaaaattcaaaaagtttacatta

SEQ ID NO: 57880 - DNA, 361 bp, Homo sapiens
  misc_feature 11: n = A,T,C or G
ggtccaaagangcaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagtataagtaacatgaaaacattctcctccgcataagcctgcgtcagattaaaacactgaactgacaattaacagcccaatatctacaatcaaccaacaagtcattattaccctcactgtcaacccaacacaggcatgctcataaggaaaggtt

SEQ ID NO: 57881 - DNA, 137 bp, Homo sapiens
  misc_feature 15, 25: n = A,T,C or G
gagaaaaagaaggantgatcagagncattgtgcaatacagtttcattaactccttcccccgctcccccaaaaatttgaatctttttttcaacactcttacacctgttatggaaaatgtcaacctttgtaagaaaacc

SEQ ID NO: 57882 - DNA, 222 bp, Homo sapiens
  misc_feature 1, 18, 61, 91, 107, 175, 191, 216: n = A,T,C or G
ntggcattagtaattgtngacttgcattcagaaacataaatgcacaaaatctgtacatgtntcccatacagaaagattcattggcatgccncaggggatatctcctncttcatcctgtaaaggtcacacaataacaagccaaattatggggctgcattttgtcacactagcatanagaatgcgttgaaatntaactttgtcagctatgtatgtggntgtatg

SEQ ID NO: 57883 - DNA, 499 bp, Homo sapiens
  misc_feature 7: n = A,T,C or G
tcggccnttattggccggggaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaag

SEQ ID NO: 57884 - DNA, 480 bp, Homo sapiens
ggaagcggcgagtttccgatttaaagctgagctgcgaggaaaatggcggcgggaggatcaaaatacttgctggatggtggactcagagaccaataaaaataaactgcttgaacatcctttgactggttagccagttgctgatgtatattcaagatgagtggattaggagaaaacttggatccactggccagtgattcacgaaaacgcaaattgccatgtgatactccaggacaaggtcttacctgcagtggtgaaaaacggagacgggagcaggaaagtaaatatattgaagaattggctgagctgatatctgccaatcttagtgatattgacaatttcaatgtcaaaccagataaatgtgcgattttaaaggaaacagtaagacagatacgtcaaataaaagagcaaggaaaaactatttccaatgatgatgatgttcaaaaagccgatgtatcttctacagggcagggagttattgat

SEQ ID NO: 57885 - DNA, 489 bp, Homo sapiens
  misc_feature 2, 20: n = A,T,C or G
cntttattggccgggggaancagcagtgttctcacagtgtggggcagccgtccttctaatgaagacaatgatattgacactgtccctctttggcagttgcattagtaactttgaaaggtatatgactgagcgtagcatacaggttaacctgcagaaacagtacttaggtaattgtagggcgaggattataaatgaaatttgcaaaatcacttagcagcaactgaagacaattatcaaccacgtggagaaaatcaaaccgagcagggctgtgtgaaacatggttgtaatatgcgactgcgaacactgaactctacgccactccacaaatgatgttttcaggtgtcatggactgttgccaccatgtattcatccagagttcttaaagtttaaagttgcacatgattgtataagcatgctttctttgagttttaaattatgtataaacataagttgcatttagaaatcaaacataaatcacttcaactgcca

SEQ ID NO: 57886 - DNA, 497 bp, Homo sapiens
  misc_feature 2, 9: n = A,T,C or G
anctcggcncttattggccggggacaacttggtatatgatgtggcacaactaggtagtgaggttgcttaaagaagatgattatttagatttagtaggagtactggctatttggaaaaaaaagctagatccctactttcaactttatatgcaaaggctaactcttgaaggattaaagacctaaataagaaatataacacttatatttaatgaattcacttatatttagtgaatattcacttatatttagtgaatagtaggctgggcatggtggcttatgcctgtaatcccagcactttgagtggtcaggagttcaagaccagcctggccaacatggtgaaatcctacctctactaaaaatacaaaaattagctggtttggtgggtggacaccttgtagtcccagctactcgggaggctgaggcaggagaatcacttgaacccaggaggcggaggtttccgtgagccaagatcgtgccactgcactccagcctcggtga

SEQ ID NO: 57887 - DNA, 218 bp, Homo sapiens
  misc_feature 24: n = A,T,C or G
gatcctagtaattgcctagaaaantctttctcttacctgttatttactcaactttttcccagtattttttactacggaaaaaattgtattgaaaacacttagtatgcagttgataagaggaatttggtataattatggtgggtgattattttttatactgtatgtgccaaagctttactactgtggaaagacaactgttttaataaaagatttacatt

SEQ ID NO: 57888 - DNA, 476 bp, Homo sapiens
tatggccggggagtgtgggtgggctgagagttaaagacagtgtggctgcagtagcatagaggcgcctagaaattccacttgcaccgtagggcatgctgataccatcccaatagctgttgcccattgacctctagtggtgagtttctagaatactggtccattcatgagatattcaagattcaagagtattctcacttctgggttatcagcataaactggaatgtagtgtcagaggatactgtggcttgttttgtttatgtttttttttcttattcaagaaaaaagaccaaggaataacattctgtagttcctaaaaatactgacttttttcactactatacataaagggaaagttttattcttttatggaacacttcagctgtactcatgtattaaaataggaatgtgaatgctatatactctttttatatcaaaagtctcaagcacttatttttattctatgcattggtttgtct

SEQ ID NO: 57889 - DNA, 493 bp, Homo sapiens
  misc_feature 2, 3: n = A,T,C or G
gnnccctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtcttgggtttcatccatccgacattgaagctgacttactgaagaatggagagagaattgaaaaagtggagcattcagacttgtctttcagcagggactggtctttctatctcttgtactacactgaattcaccccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattgatatgcttatacacttacactt

SEQ ID NO: 57890 - DNA, 266 bp, Homo sapiens
  misc_feature 23: n = A,T,C or G
atatttctaaaacttaattaagnctctaggtcagataacaatggagtaaagtgatacctgcatttttttccccagtgtaatcttaatttactattgtatttttcacttaaaattttgtagggaaaaaaagttttcaagggaacactaagattaaattgactaggttcaaatatgcttccttatgagattcaaaatttactgtgtgaaattaaagtttaagagacctaaaaaaatgtactcccaataaagaatcaatactgcttcac

SEQ ID NO: 57891 - DNA, 471 bp, Homo sapiens
gattcagaatatgaaggaggaaatggctcgtcaccttcgtgaataccaagacctgctcaatgttaagatggcccttgacattgagattgccacctacaggaagctgctggaaggcgaggagagcaggatttctctgcctcttccaaacttttcctccctgaacctgagggaaactaatctggattcactccctctggttgatacccactcaaaaaggacacttctgattaagacggttgaaactagagatggacaggttatcaacgaaacttctcagcatcacgatgaccttgaataaaaattgcacacactcagtgcagcaatatattaccagcaagaataaaaaagaaatccatatcttaaagaaacagctttcaagtgcctttctgcagtttttcaggagcgcaagatagatttggaatagggaataagctctagttcttaacaaccgacactcctacaagatttaga

SEQ ID NO: 57892 - DNA, 499 bp, Homo sapiens
  misc_feature 9: n = A,T,C or G
ctcggcccntattggccggggagaggtgccatatgcataagccaaatgcacaaaacctgtgattttgacctctattataatagactctatgatatatcaaagtactttatagcagaggtttattatattttcaaattgctatatatattttatataaaattgtattccataactgttatttaaatatgatgatacatgtgaaaatatcttacaacgtatttgtcattaaaagtgaagtatgatttttaaataatctgataagaaccacagaggaaactggagaggccacatctggagaactgttttcaaccaattatgatgatattaatgatggcagtgttgatgatgatgatacctaatgcaaatggagtacttgctgtgtgccaagcgctgtgctaaggatgacttcatgtgcatcataccatttgtcttcataataaccctctgaagttggaactataactaaatctaaccccatagaagaggaaattgagacata

SEQ ID NO: 57893 - DNA, 139 bp, Homo sapiens
  misc_feature 120, 136, 138: n = A,T,C or G
gatgaaagttatagtgaagaggaggaagagatgcccgacagtgatgaaaatggatcctatagcaccagctctgatccatcagatgatagcaaagcagtagctataatcaagtctgttggngaactatcagtaccananc

SEQ ID NO: 57894 - DNA, 197 bp, Homo sapiens
  misc_feature 4, 6: n = A,T,C or G
tctncnaccacaagctgcttttccctctggtctttcactatatcgataaattaggttttctttagtctctttagaattggatccttgtctccattgctcctaccctgcttctgaggagccctcattgcagtagttttttgattagtctcttgcttctttttgttccattctttttatttatttttagagactgtctc

SEQ ID NO: 57895 - DNA, 472 bp, Homo sapiens
  misc_feature 9, 232: n = A,T,C or G
aactctgangctttacacaggttatgaaacttgtcctagtacattggcctcagaagacaggcataaagcactctttgtgaactgcttagctttgtaaggtctatctggcacctgaacaagcaacattttgcaaaacatcaggctctgcatgaaaattcagattcccacactgagagtccattgagagatctcccactcattagcatgctacaaggccgctgaaagatcaggnaagatgtcaaaagggcaaaccttcacataaacagaactcagagaaacaaactgaacttaacttggcatcagccaactgtaagtatgaaaaaaaaatgtgtttattggggatgagaagaaggaaaattcactaatttgtctacatgcaactaagtgatatttttccttggtaaaattaattgcaaaggcagccagatgcagtggctcctgcctgcaatcccagcactttgggaggccaagg

SEQ ID NO: 57896 - DNA, 498 bp, Homo sapiens
  misc_feature 5, 6: n = A,T,C or G
gtatnncaaaggctgggctcttttgaaggattggtaaacctgaccttcatccatctccagcacaatcggctgaaagaggatgctgtttcagctgcttttaaaggtcttaaatcactcgaataccttgacttgagcttcaatcagatagccagactgccttctggtctccctgtctctcttctaactctctacttagacaacaataagatcagcaacatccctgatgagtatttcaagcgttttaatgcattgcagtatctgcgtttatctcacaacgaactggctgatagtggaatacctggaaattctttcaatgtgtcatccctggttgagctggatctgtcctataacaagcttaaaaacataccaactgtcaatgaaaaccttgaaaactattacctggaggtcaatcaacttgagaagtttgacataaagagcttctgcaagatcctggggccattatcctactccaagatcaagcatttgcgtttggatggc

SEQ ID NO: 57897 - DNA, 243 bp, Homo sapiens
  misc_feature 134, 142, 187, 189, 220, 223, 240: n = A,T,C or G
ggattcctgaatctgacagcattcgggcccgagatgtctcgctccgtggccttagctgtgctcgcgctactctctctttctggcctggaggctatccagcgtactccaaagattcaaggtttactcacgtcatncagcaganaatggaaagtcaaatttcctgaatgctatggggctggggttcatncntcccacattgaagttgacttactggaaaaanggnaaaaaaattggaaaaanggg

SEQ ID NO: 57898 - DNA, 277 bp, Homo sapiens
  misc_feature 14: n = A,T,C or G
agacacaggaagancacgtctgtccaccacagactgccagtgcagcccgaccctgagccgtgtgcagggcaaccttcggattccttatactctctctgaaggcaaagatggggacaaggactaagagtcagaatgttgacactttgatgaaatggagtagagaaatgcattctgtaagtggtcaaaggacatttgactgtttactttctccacactaagtcttctccatgttttgtggccttcggttgtaataaacttggcttctttatacatctgt

SEQ ID NO: 57899 - DNA, 490 bp, Homo sapiens
caagcattccaataataaggcctgactacgggggcaattgctgcaatgctgtctacaatcctgtattcaaggcgcttctctccatactatgtttacaacatcatcggtggacttgatgaagaaggaaagggggctgtatacagctttgatccagtagggtcttaccagagagactccttcaaggctggaggctcagcaagtgccatgctacagcccctgcttgacaaccaggttggttttaagaacatgcagaatgtggagcatgttccgctgtccttggacagagccatgcggctggtgaaagatgtcttcatttctgcggctgagagagatgtgtacactggggacgcactccggatctgcatagtgaccaaagagggcatcagggaggaaactgtttccttaaggaaggactgatctgtgtgctcttatcaccaatcagttcagacctggtcgattttgtactttggaactgtaccttggatgggtt

SEQ ID NO: 57900 - DNA, 491 bp, Homo sapiens
  misc_feature 3: n = A,T,C or G
atnacacgcttttgtttttaaattgacctgccaaggtagctgaagaccttttagacagttccatcttttttttaaattttttctgcctatttaaagacaaattatgggacgtttgtagaacctgagtatttttctttttaccagttttttagtttgagctcttaggtttattggagctagcaataattggttctggcaagtttggccagactgacttcaaaaaattaatgtgtatccagggacattttaaaaacctgtacacagtgtttattgtggttaggaagcaatttcccaatgtacctataagaaatgtgcatcaagccagcctgaccaacatggtgaaaccccatctgtactaaacataaaaaaattagcctggcatggtggtgtacgcctgtaatcccagtgacttgggaggctgaggcaggagaatcgcttgaacccgggaggcggaggttgcagtgagctaagatcgcgccactgtactccag

SEQ ID NO: 57901 - DNA, 367 bp, Homo sapiens
  misc_feature 13, 26: n = A,T,C or G
attggcgcggganttcattcaggaantacaaagaactagttgaaaagctgttagaaggttaccctcaaagaaattggaattaatgaagatcaatttcaagaagcatgcacttctcctcttgcaaagacccatacatcacaggccattttgcaacctgtgttggcagcagaagattttactatctttaaagcaatgatggtccagaaaaacattgaaatgcagctgcaagccattcgaataattcaagagagaaatggtgtattacctgactgcttaaccgatggctctgatgtggtcagtgaccttgaacacgaagagatgaaaatcctgagggaagttcttagaaaatcaaaagaggaatatgacc

SEQ ID NO: 57902 - DNA, 113 bp, Homo sapiens
gatgtaaaattatattatggcgcctaatgatgataacaaagaaaacaatatactgatcttagaaaatgtagacatggttaactgggaaataaaatatagagtggcacttcaag

SEQ ID NO: 57903 - DNA, 489 bp, Homo sapiens
  misc_feature 6, 9: n = A,T,C or G
cataantangataatatgccaaaatttataaggaatgcatacaactcaataacaagaaaatagataacccaattaaaaaatgggcagtggaactgagtagacatttttgcaaagaagttataaaaatggcaaacacatatatgaaaagacatttaacatcactaatcgtcagggaaatgcaaatcaaaattactatgcgatatcacctcacactcatgagaatagctattaagtgttggctagggttagggaactcttgtacagtgttggtgggactgtagattggtgcagtcataatgaaaaacagaatggtggctcctaaagaaattgaaaatatactatcatctgacccactaatccctcttctaggtatattcccaaagaaaatgaaatctccacctcataaagatatctgcgctcctatattcattgtggcattatatgcatgagtcacgatatgaaaacttacgtgtccattgatggatgact

SEQ ID NO: 57904 - DNA, 474 bp, Homo sapiens
aagggaccttggttttcttctagatagcagctgtcccaaagaaaatatttcttctttgtctgttaagatttagctattatctgccagttgttaagaggttttggttccaaactcaaccagcaatgttgagagctgaacttaagatagctgttgtactttttgctttccatctgttactgtccttcattcttggctccctactatctataaacagctgctgtgaagaagaaaagttgaataagagttggcttaaattttaaaaaagaaaaagaaaattgaggttttaggattttcatggtaacaagctctggtataagctaaggctggcaagttcagatactaaaatattatttgatcatatcttggatccttttgaaaaagttaagactatatgaaggtaaattagaaataagtatgaatattaataaaatagcatttatcttatttctctattttatgttgggacttaaccta

SEQ ID NO: 57905 - DNA, 465 bp, Homo sapiens
  misc_feature 14: n = A,T,C or G
gcagcaaacaaagncgttcacctctacaaactgggaaaaatgaagacaagaactctatctactgaaattattttcaacctttccccaaataacaatatttcagaggctttgaaaaaatttggtatctcagcaaatgacacttcaattctaattgtttacattgaagagggagaaaaacaaataaatcaagaatacctaatatctcaagtagaaggtcatcaggtttctctgaaaaatcttcctgaaataatgaatattacagaagtcaaaaaggtttgccagtccatatttttagaaagagtgtgatagatgagcaataatgctgatgccgtttgcctattgatcaccagagctccttgttttttgaacttttgagaaagttaatctaattttaaaaattacttaaaaattacagatacaaagaactgggaggtgtgatggtttatgtaaaatataattacaaac

SEQ ID NO: 57906 - DNA, 332 bp, Homo sapiens
  misc_feature 27: n = A,T,C or G
ggaggcggaggttgtggtgagccaagnatcacgccattgcactccagcctgggcaacaagagcgaaactccatctcaaaaacaaaaagaaagaaagaaaaaagaaagaatatgataaaaaaactaaatagggaaaaatcttaggaaaacgaatgcatgtcaagtatgaaaagacagatggtaaatatgtattaaacataaagagctgattcacatgcttaggtaaaagaaacctgtggggatgtataagcagtgaatatgaatagataataacccaagaagaacaatgtatgacagacaattacagtgaaatctctctcttacattaataat

SEQ ID NO: 57907 - DNA, 385 bp, Homo sapiens
  misc_feature 8, 17: n = A,T,C or G
aacgtcantttcggctncttatggaccgggcaatcctttgaatgttccacgggaaacactggtggacagattctagtgctgagaagaaacacgtttggtttggagagtccatggatggtggttttcagtttagctacggcaatcctgaacttcctgaagatgtccctgatgtgcagctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgaaacacactgaagg

SEQ ID NO: 57908 - DNA, 144 bp, Homo sapiens
atggcacatgcagcgcaagtaggtctacaagaacgctacttcccctatcatagaagagcttatcacctttcatgatcacgccctcataatcattttccttatctgcttcctagtcctgtatgcccttttcctaacactcacaac

SEQ ID NO: 57909 - DNA, 409 bp, Homo sapiens
  misc_feature 4, 12: n = A,T,C or G
caanttcggctnttatggaccggggggggtgtaaatcagtgcaatcactttgggaaacattgacagtatctactaaagctgaacatacacagcctataatccagcaattccactaatgaatataaacccaattaaactacatgcatatgtctgccaaacacatgtacaaacatgtatgtagtggcttattcataataaccaaaaactggaaacagcccaaatgtccagagacagtggaatggataaataaagtttggtatattcaatacagtggagtacaatatgggaatggaaaagaacacactttgctacatgcaactatctggattcacctcacagacaacattttgagcagagaaactgcatgatttaataatgcaaagttcttgaacaggcaaaaccaatcaat

SEQ ID NO: 57910 - DNA, 400 bp, Homo sapiens
gggggaaagatattcttggaaccactcatgacatatcttagaaggtcattgacaatgtataaactaattgttggtttgatatttatgtaaatatcagtttaccatgctttaattttgcacattcgtactatagggagcctattggttctctattagtcttgtgggttttctgtttgaaaaggagtcatggcatctgtttacatttaccttatcaaacctagaatgtgtatatttataaatgtatgtcttcattgctaggtactaatttgcagatgtctttacatatttcaatacagaaactataacattcaatagtgtgctgtcaaagtgtgcttagctcacctggatatacctacattgttaaatgtctaaacagtaatcattaaaacatttttgacca

SEQ ID NO: 57911 - DNA, 370 bp, Homo sapiens
ggctctaagctgcagcaagagaaactgtgtgtgaggggaagaggcctgtttcgctgtcgggtctctagttcttgcacgttctttaagagtctgcactggaggaactcctgccattaccagctcccttcttgcagaagggagggggaaacatacatttattcatgccagtctgttgcatgcaggctttttggcttcctaccttgcaacaaaataattgcaccaactccttagtgccgattccgcccacagagagtcctggagccacagtcttttttgctttgcattgtaggagagggactaagtgctagagactatgtcgctttcctgagctaccgagagcgctcgtgaactggaatcaactgcttcaggt

SEQ ID NO: 57912 - DNA, 226 bp, Homo sapiens
gatcaaaagggacaagcatcaagcacgcagcaatgcagctcaaaacgcttagcctagccacacccccacgggaaacagcagtgattaacctttagcaataaacgaaagtttaactaagctatactaaccccagggttggtcaatttcgtgccagccaccgcggtcacacgattaacccaagtcaatagaagccggcgtaaagagtgttttagatcaccccctcccc

SEQ ID NO: 57913 - DNA, 130 bp, Homo sapiens
  misc_feature 24, 29, 30, 39, 44, 51, 61, 66, 69, 83, 105, 117, 121: n = A,T,C or G
gataaggaagaatgcctaaaaccnttctnnaagggggtngctcntctctgnatgagtacanatacnatncaccatgatgaagntcgcctgctttgaacgtactgntgaagcactgtncaantttgtggtt

SEQ ID NO: 57914 - DNA, 376 bp, Homo sapiens
  misc_feature 2, 13: n = A,T,C or G
gntgcaatatgtntgtgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacatt

SEQ ID NO: 57915 - DNA, 473 bp, Homo sapiens
aaacgttaaaacatatcaaccgtttgtagataacatacaactgtagatgctgaaaaagggtagtctaggaagacagacaggagacagctaatagcaaaatatgtttatcttgtgatctagtgacttaaagctccaagttagtagattcctgatgagaaagctgatgatgattaactttcagaattcttaagttaaacggcaatggagactgtaaaaattaactaacctacagggttaaataaatgctgactgctgcctttttctaagggtttagaaaggattgagtaagagcatatatttaaaggtgagctaaagtaatcaatgcagttttaggcaacgaatagtgaggttttgaagggcagatatggtagttattgttttggggagaggaacaaaaaacatgattgtgtttggaagaatttacaaacaatgttttggttggggtatttctgaagttgtcttctggtttaatc

SEQ ID NO: 57916 - DNA, 171 bp, Homo sapiens
aaagaaggaataatctaccctgactaaagcttgaaatgctacatttccaaggtgaagatgtgtgggcacatgttatggcagattgaaaaggatctcattccatgggaaaaaaaaaatcctgtcttgttcataaattgacaatgtcaataaattgaaatatggttcactgtt

SEQ ID NO: 57917 - DNA, 424 bp, Homo sapiens
  misc_feature 3, 14, 37, 42, 62, 78, 86, 118, 123, 155, 181, 196, 245,273, 280, 284, 350, 355, 401: n = A,T,C or G
ggnaaggtagtaangaagtacagaaaaatttgctatnatgtngaaaattctggggaacctcnaataactcactttatntttagcangagtttatgcttcagagatcatctgtccctgnaatanacattttatcatgggaagggtggggtcagcantagaaaactatgatctcagcagaagnccctctaccaccccntagcttagtaattttcttaccaacagctagctgaggtagtgtgcatccnagacgctccgcaattggggaaaggtctnttagctngttntgctgttttctcccttcttcacttacaattctttctttcaaccactggtagcactggggaaaagcntaacnttgaaatgttaatgtctggtaaagatctgatgtcaaagaatggtanttcaataaaatatgtgaacccct

SEQ ID NO: 57918 - DNA, 414 bp, Homo sapiens
gggattaagctcactgcaataaatatacacaatattgaaaatgaaggtgaattccatggaatactatgcagccataaaaaaggatgagatcatgtcctttgcagggagatggatgaagctggaaaccatcattctcagcaaactatcacaaggacagaaaaccaaacaccgcatgttctcactcataggtgggaactgaacaatgagaacactcggacacagggcagggaacatcacacacgagggcctgtcagtgggtagggggctgagggagggatagcattaggagaaatacctaatataaatgacgagttgatgggtgcagcaaaccaacatggcacatgtatgcctatgtaacaaatctgcacattgtgcacatgtaccctagtacttaaagtataaaaaaaaaagact

SEQ ID NO: 57919 - DNA, 142 bp, Homo sapiens
  misc_feature 84, 118: n = A,T,C or G
gtatctcattttgaaggaatttaatattttaagcaaggatgttcaaaatcttacatataataagtaaaaagtaagactgaatgnctacgttcgacacccagtacatatcaaaatattnaaaccagcattacaaaatcctact

SEQ ID NO: 57920 - DNA, 431 bp, Homo sapiens
catggatggtggttttcagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatccc

SEQ ID NO: 57921 - DNA, 323 bp, Homo sapiens
  misc_feature 16, 37: n = A,T,C or G
atggccggggtacagnaacaaacacacaacataccancaatctctgggacgcattcaaagcagtgtgtagagggaaatttatagcactaaatgcccacaagagaaagcaggaaagatgtaaaattgacaccctaacatcacaattaaaagaactagaaaagcaagagcaaacacattcaaaagctagcagaaggcaagaaataactaaaatcagagcagaacttaaagaaatagagacacaaaaaacccttcaaaaaattaatgaatccaggagctggtttttttgaaaggatcaacaaaattgatagaccgctagcaagact

SEQ ID NO: 57922 - DNA, 487 bp, Homo sapiens
  misc_feature 3: n = A,T,C or G
ccnttatggccggggaggcattgaggcagccagcgcaggggcttctgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgggatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaatattttgaaggcgatcttttaaaaagagattaaacccgaaggtga

SEQ ID NO: 57923 - DNA, 480 bp, Homo sapiens
  misc_feature 14: n = A,T,C or G
aatcctatttattngtattgctgcttcacatctccaggaataagccttccgatgccaggacagtgactgcctgaaagctgcaggagctcttttcaatgcattttatatatttttagaaaccaaataaatgcagaaaactatttagtatactaattatattaaaccagcagaaatataaaggcaataaagtatatacatatatatggggggaggggaaagattaaaaaatagatttacagccagacatggtgatagccctaaatgtatttctcaatatgtttttctttattgaccctaggaggatttgagttgctgcagctttaaacagaaaattgccatgttcactaattgtgagcacataaatatgcttttagtactgctttgcttatgtacaaataaatctgtaatatgtattatatgtaattatccttttctttgactttcattttaaatgtatattttctgatcattatgagctgt

SEQ ID NO: 57924 - DNA, 397 bp, Homo sapiens
  misc_feature 1, 310, 312, 347, 363: n = A,T,C or G
nactctatatacttttgcttggttcattttttttcccttttagttaagcatgactttagatgggaagcctgtgtatcgtggagaaacaagagaccaactttttcattccctgcccccaatttcccagactagatttcaagctaattttctttttctgaagcctctaacaaatgatctagttcagaaggaagcaaaatcccttaatctatgtgcaccgttgggaccaatgccttaattaaagaatttaaaaaaagttgtaatagagaatatttttggcattcctctaatgttgtgtgttttttttttgtgngngctggagggaggggatttaattttaattttaaaangtttaggaaatttatncaaagaaactttttaataaagtatattgaaagtc

SEQ ID NO: 57925 - DNA, 429 bp, Homo sapiens
taagatagttatagtgatatatctttgtattgttattgcacttttcactttgttatatgatcatatattttgacatctttttgatggttttataaacaaagatactgtcaaaatggaaaatactagattgaggaccgggcatggtggcttacgcctgtaatcccagcactttgggaggccaaggtgggcagatcacgaggtcaaaagatcgagaccatcctggccaacatggtgaaaccccatatctactaaaaatacaaaaattagctgggcgtggaatcgtgtgcctgtagtcccagttactcaggaggctgaggcaggagaatcgcttgaacctgggaggcggaggttgtggtgagccaaggttgtggtgagccaaggtcacgccactgcactgcagcctgagcaacaagagcaaaactctgtctg

SEQ ID NO: 57926 - DNA, 471 bp, Homo sapiens
  misc_feature 436: n = A,T,C or G
ggagaatcccaagaagtacatccctggaacaaaaatgatctttgtcggcattaagaagaaggaagaaagggcagacttaatagcttatctcaaaaaagctactaatgagtaataattggccactgccttatttattacaaaacagaaatgtctcatgacttttttatgtgtaccatcctttaatagatctcatacaccagaattcagatcatgaatgactgacagaatattttgttggggcagtcctgatttaaaactaagactggcttgtggttaaatgaatattgttcagtttttgaattttaatagtaactccaattcagtaaatggtatcactgtttaccccttttaaagatatgattagacttcgttagtaatgttcaacttttcacaaagatggtgagtgccatcttaaaacttactggagattggtttntattttagatttatattaactggggtatgtgaata

SEQ ID NO: 57927 - DNA, 263 bp, Homo sapiens
gtggtgtattttttaaaaaatttgatttagcattcatattttccatcttattcccaattaaaagtatgcagattatttgcccaaagttgtcctcttcttcagattcagcatttgttctttgccagtctcattttcgtcttcttccatggttccacagaagctttgtttcttgggcaagcagaaaaattaaattgtacctattttgtatatgtgagatgtttaaataaattgtgaaaaaaatgaaataaagcatgtttggtttt

SEQ ID NO: 57928 - DNA, 365 bp, Homo sapiens
ggaagagggagtcaccactggacctccaaggaagccacgtgcagacatctacaaccttcgatctcctgacgagtttattgttggccaaaaccaggctttgattgaaccaggatgaatgcgggtgttggaagtagaatatatatatacatataaaattgaaactggcgatggaatatgagaggagccctctggaaagaaaaggacagaccctgtgctttcatgaaagtgaagatctggctgaaccagttccacaaggttactgtatacatagcctgagtttaaaaggctgtgcccacttcaagaatgtcattgttagactttgaaatttctaactgcctacctgcataaagaaaataaaatctttt

SEQ ID NO: 57929 - DNA, 329 bp, Homo sapiens
  misc_feature 18, 327: n = A,T,C or G
tcaccaagtctgcccagnaaagctcagaaggctaaatgaatattatccctaatacctgccactccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaantc

SEQ ID NO: 57930 - DNA, 472 bp, Homo sapiens
accaaaatgcctctcaaatggaacacgccatggaaaccatgatgtttacatttcacaaattcgctggggataaaggctacttaacaaaggaggacctgagagtactcatggaaaaggagttccctggatttttggaaaatcaaaaagaccctctggctgtggacaaaataacgaaggacctggaccagtgtagagatggcaaagtgggcttccagagcttcttttccctaattgcgggcctcaccattgcatgcaatgactattttgtagtacacatgaagcagaagggaaagaagtaggcagaaatgagcagttcgctcctccctgataagagttgtcccaaagggtcgcttaaggaatctgccccacagcttcccccatagaaggatttcatgagcagatcaggacacttagcaaatgtaaaaataaaatctaactctcatttgacaagcagagaaagaaaagttaaata

SEQ ID NO: 57931 - DNA, 315 bp, Homo sapiens
gcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctccctgccacattgagatgatccttacggaaaaggaacagattgttcctaaaccagaagaggaggttgcccagaagaaaaagatatcccaga

SEQ ID NO: 57932 - DNA, 388 bp, Homo sapiens
  misc_feature 13, 16, 344, 356, 378: n = A,T,C or G
ggttgaaactagnagnatggacaggttatcaacgaaacttctcagcatcacgatgaccttgaataaaaattgcacacactcagtgcagcaatatattaccagcaagaataaaaaagaaatccatatcttaaagaaacagctttcaagtgcctttctgcagtttttcaggagcgcaagatagatttggaataggaataagctctagttcttaacaaccgacactcctacaagatttagaaaaaagtttacaacataatctagtttacagaaaaatcttgtgctagaatactttttaaaaggtattttgaatactattaaaactgcttttttttttccagcaagtntccaaccaactnggttctgcttcaataaatcttnggaaaaactt

SEQ ID NO: 57933 - DNA, 477 bp, Homo sapiens
atatgttaaagtatagataacatttcacacttggatacatatgtgcatttactgtatttcttggtaagcatatttttgggggaaagtgctgctgatatgatacaagtagacaaaatttaaatgaaattttgtcacattctatggaaaatggtttctggtaaactgagaaggatattaaaataagtggcttttttctgggctaccattattgtttgatttctctttgtcaagtgtatagaacctgtcatacattcatgataagtagcactgaaaaattactcattcaaatttcccctgggcacgtaaggcaaaatattgccggttgggatttcaaggtcagtgacgacgcatttcctcccagtacagaccccccagccccccttgctggacatggggaggcaggagagtcacttgaccatccagaaatacatgactacaagtcctttatgactgtttgccattttttttaatggactt

SEQ ID NO: 57934 - DNA, 471 bp, Homo sapiens
  misc_feature 440: n = A,T,C or G
tatggccgggggaacctgagggaaactaatctggattcactccctctggttgatacccactcaaaaaggacacttctgattaagacggttgaaactagagatggacaggttatcaacgaaacttctcagcatcacgatgaccttgaataaaaattgcacacactcagtgcagcaatatattaccagcaagaataaaaaagaaatccatatcttaaagaaacagctttcaagtgcctttctgcagtttttcaggagcgcaagatagatttggaataggaataagctctagttcttaacaaccgacactcctacaagatttagaaaaaagtttacaacataatctagtttacagaaaaatcttgtgctagaataccttttaaaaggtattttgaataccattaaaactgcttttttttttccagcaagtatccaaccaactnggttctgcttcaataaatctttggaaaaccg

SEQ ID NO: 57935 - DNA, 201 bp, Homo sapiens
  misc_feature 16, 26: n = A,T,C or G
caggctcaattattgngaccgcgganccccaggggaccccacgcacattccgttgccttacccgatggcttgtgacgcggagagaaccgattaaaaccgtttgagaaactcctcccttgtctagccctgtgttcgctgtggacgctgtagaggcaggttggccagtctgtacctggacttcgaataaatcttctgtatcct

SEQ ID NO: 57936 - DNA, 476 bp, Homo sapiens
  misc_feature 9: n = A,T,C or G
gaggcgagnagctgcgaaggcgagagctgcgaagggccaggtgtcgggcgctgtttctcgttttcatcatatagacaaaacagccctgctgcaaagatggtcaacgtacctaaaacccgaagaaccttctgtaagaagtgtggcaagcatcagcctcacaaagtgacacagtataagaagggcaaggattctttgtatgcccagggaaggaggcgctatgatcggaagcagagtggctatggtgggcagacaaagccaattttccggaagaaggctaagaccacaaagaagattgtgctaaggctggaatgtgttgagcctaactgcagatccaagaggatgctggccattaagagatgcaagcattttgaactgggaggagattaagaagaagaaagggccaagtgatccagttctaaactttgggatatttttcttcaattttgaagagaaaatggtgaagccatagaaaagtt

SEQ ID NO: 57937 - DNA, 470 bp, Homo sapiens
  misc_feature 25, 170, 174, 177, 205, 317: n = A,T,C or G
gaatgacactgttccaggaatcggnaatcctgtcgattagactggacagcttgtggcaagtgaatttgcctgtaacaagccagattttttaaaatttatattgtaaatattgtgtgtgtgtgtgtgtgtgtatatatatatatgtacagttatctaagttaatttaaagntgtntgngcctttttatttttgtttttaatgcttngatatttcaatgttagcctcaatttctgaacaccataggtagaatgtaaagcttgtctgatcgttcaaagcatgaaatggatacttatatggaaattctgctcagatagaangacagtccgtcaaaacagattgtttgcaaaggggaggcatcagtgtccttggcaggctgatttctaggtaggaaatgtggtagcctcacttttaatgaacaaatggcctttattaaaaactgagtgactctatatagctgatcagttttttca

SEQ ID NO: 57938 - DNA, 329 bp, Homo sapiens
  misc_feature 2: n = A,T,C or G
gnacctacgcacacgagaacatgcctctcgcaaaggatctccttcatccctctccagaagaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggat

SEQ ID NO: 57939 - DNA, 284 bp, Homo sapiens
gaaaggcctagttaataaatgtccataaatgtagccaactttattgcaagccatgctgcccccaaaatagccctaagagttgtacctgaccaaataactcagtccagttttacaggacgtgaagactgagtattccatccccagacaatgcaatttcagttatctgagtttttaatcctgactgggatgagagaaggctgagtgatagaagtatctgaatatgtggtattattcctcctgcaactcagggaagaacagagaaactggcaaagtgaacatcctac

SEQ ID NO: 57940 - DNA, 404 bp, Homo sapiens
atattactgtttcacatgtacagctttctacttctttgtaagaacaccaaccaaccaaggtttaagtgattaataggcttgagcaccgggtggcagatgttctatgcagtgtggttcaagtttctttgaccgcacttatatgcattgctaatatggaatttaagataccatacacagtctctcatggacctatctctattgtagaattatgacttatgtcttacttggcaaatttttctgaatgtgacctttttttgctgatttgctgggtttgggattaactagcattattttgccacctttatattgtatttataaaaaaaaagtactatcaatcaatcatactactttggattgttgtgctggtgtaatgtggatttaacatcaataaatatttgacaaat

SEQ ID NO: 57941 - DNA, 184 bp, Homo sapiens
  misc_feature 7: n = A,T,C or G
gctgaangaaaactgatagtcactattatttagaacatgaaaatgaatgaattagacatgtaacacaagggaaaaaagtaacaatatggataagactagaaataaatcagaggaaagcaaataggcaacctcctggcaaatgcattttctaaaaaaatcaaaatcagaaataataaagttaatg

SEQ ID NO: 57942 - DNA, 270 bp, Homo sapiens
  misc_feature 4, 6: n = A,T,C or G
cccnanaataggtgtccctccaaagcgacctgatggaagtcctgaacttggaaattaggttctactcacttggacatccctgcatcatggactgttgctgctccctgttccatatgctcgcaatctcagctatttggaagctaccaggaatgctttctaattatcatttgcaactagaactgtaatcagaaagaaattttgtatttttgtataacttgattgtgtgccattttatataacaggtcctgttttacaaataaattttgtttt

SEQ ID NO: 57943 - DNA, 500 bp, Homo sapiens
  misc_feature 11, 29, 60, 69, 79, 80, 85, 86, 87, 89, 169: n = A,T,C or G
gatttttgtancgcgggggaattcggctncttatggcgcgggggtcgagcaagcagcctncccaagctnccagggagcnngccgnnnanaaggaccagagagggaaggtgacctgaaagtcacagaataattttttagagctgaacaagaatccaagcctgcaactgcngagacgagagatctttctgctgtctatactcttggaaagcacatcctaagatctttgcagattatcctgtggaaggaaaatgcctaaagtcaaaagaagccggaaagcacccccagatggctgggagttgattgagccaacactggatgaattagatcaaaagatgagagaagctgaaacagaaccgcatgagggaaagaggaaagtggaatctctgtggcccatcttcaggatccaccaccagaaaacccgctacatcttcgacctcttttacaagcggaaagccatcagcagagaactctatgaatattgtattaaagaaggctatgca

SEQ ID NO: 57944 - DNA, 499 bp, Homo sapiens
  misc_feature 2, 21, 29, 49, 50, 54, 60, 63, 148, 155, 183, 247, 301, 366,378, 472: n = A,T,C or G
gnacggcacgttcggcgcctnatcgaccnggcatgtcgaatttgcctgnnacangcccancantttttaaaatttatattgtaaatattgtgtgtgtgtgtgtgtgtgtatatatatatatgtacagttatctaagttaatttaaagntgtgtgngcctttttatttttgtttttaatgcttngatatttcaatgttagcctcaatttctgaacaccataggtagaatgtaaagcttgtctgatcgntcaaagcatgaaatggatacttatatggaaattctgctcagatagaatgacagnccgtcaaaacagattgtttgcaaaggggaggcatcagtgtccttggcaggctgatttctaggtangaaatgtggtancctcacttttaatgaacaaatggcctttattaaaaactgagtgactctatatagctgatcagttttttcacctggaagcatttgtttctacttngatatgactgtttttcggacagtttat

SEQ ID NO: 57945 - DNA, 480 bp, Homo sapiens
  misc_feature 1: n = A,T,C or G
ntcttatggccggggggggtcgactgacggtaacggggcagagaggctgttcgcagagctgcggaagatgaatgccagaggacttggatctgagctaaaggacagtattccagttactgaactttcagcaagtggaccttttgaaagtcatgatcttcttcggaaaggtttttcttgtgtgaaaaatgaacttttgcctagtcatccccttgaattatcagaaaaaaatttccagctcaaccaagataaaatgaatttttccacactgagaaacattcagggtctatttgctccgctaaaattacagatggaattcaaggcagtgcagcaggttcagcgtcttccatttctttcaagctcaaatctttcactggatgttttgaggggtaatgatgagactattggatttgaggatattcttaatgatccatcacaaagcgaagtcatgggagagccacacttgatggtggaatataaact

SEQ ID NO: 57946 - DNA, 267 bp, Homo sapiens
aagattgtatgaaccgcatggtgcttgcagttttaaatattgtggatatttgtcctgcatcagaaacgagctttggtttttacagattcaactgtgttgaaatcaaacctgccgcaacagaaattgtttttatttcatgtaaaataagggatcaatttcaaaccctgcttatgatatgaaaatattaaaacctagtctattgtagttttattcagactggtttctgttttttggttattaaaatggtttcctattttgcttattaat

SEQ ID NO: 57947 - DNA, 239 bp, Homo sapiens
aagttgcagagttctgatggagagatatttgaagttgatgtggaaattgccaaacaatctgtgactattaagaccatgttggaagatttgggaatggatgatgaaggagatgatgacccagttcctctaccaaatgtgaatgcagcaatattaaaaaaggtcattcagtggtgcacccaccacaaggatgaccctcctcctcctgaagatgatgagaacaaagaaaagcgaacagatga

SEQ ID NO: 57948 - DNA, 470 bp, Homo sapiens
gagtgatggaaaacacatgagcagtaacaagttttaatcttgctcctcagtactaacatggactaatctgtgggagcagtttattccagtatcacccagggtgcagccacaccaggactgtgttgaagggtgttttttttcttttaaatgtaatacctcctcatcttttcttcttacacagtgtctgagaacatttacattatagataagtagtacatggtggataacttctacttttaggaggactactctcttctgacagtcctagactggtcttctacactaagacaccatgaaggagtatgtgctcctattattcctggctttgtgctctgccaaacccttctttagcccttcacacatcgcactgaagaatatgatgctgaaggatttgggaagacacagatgatgatgatgatgatgatgatgatgatgatgatgatgatgatgatgaggacaactctcttttt

SEQ ID NO: 57949 - DNA, 207 bp, Homo sapiens
ctcagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaacactctttatgat

SEQ ID NO: 57950 - DNA, 296 bp, Homo sapiens
gttctgagccgtctgtcctgcgccaagatgcttcaaagtattattaaaaacgtatggatccccatgaagccctactacaccaaagtttaccaggagatttggataggaatggggctgatgggcttcatcgtttataaaatccgggctgctgataaaagaagtaaggctttgaaagcttcagcgcctgctcctggtcatcactaaccagatttacttggagtacatgtgaaagaaaacgtcagtctgcctgtaaatttcagcaagccgcgttagatggggagcgtggaacgtcactg

SEQ ID NO: 57951 - DNA, 294 bp, Homo sapiens
  misc_feature 22, 293: n = A,T,C or G
aaacctacagtctgaaaaagcngaattgtatattatactctcaccatttggatcctgtgtggagagggaatgtgaaatttacatcatttctttttgggagagacttgttttggatgccccctaatccccttctcccctgcactgtaaaatgtgggattatgggtcacaggaaaaagtgggttttttagttgaatttttttttaacattcctcatgaatgtaaatttgtactatttaactgactattcttgatgtaaaatcttgtcatgtgtataaaaataaaaaagatcccant

SEQ ID NO: 57952 - DNA, 347 bp, Homo sapiens
ataacctgaccttagaaaattgtgagagccaagttgacttcaggaactgaaacatcagcacaaagaagcaatcatcaaataattctgaacacaaatttaatatttttttttctgaatgagaaacatgagggaaattgtggagttagcctcctgtggtaaaggaattgaagaaaatataacaccttacaccctttttcatcttgacattaaaagttctggctaactttggaatccattagagaaaaatccttgtcaccagattcattacaattcaaatcgaagagttgtgaactgttatcccattgaaaagaccgagccttgtatgtatgttatggatacataaaatg

SEQ ID NO: 57953 - DNA, 245 bp, Homo sapiens
tgggaggtgaggcgggcagatcacctgaggccagcagttcgagaccagcctgggcaacatggtgaaaccccatctccactaaaaatacaaaaattagccaggcatggtggcgggcacctgtagtcccagctactcgggaggctgaggcagcagaatcgtttgaaccagggaagcagagattgcagtgagccgagatcgtgccactgtacttgagcctgggtgccagagcaagagtctcaaaaaga

SEQ ID NO: 57954 - DNA, 121 bp, Homo sapiens
gacaaactaactctctagaaaaaacgtgtgtgtgtacacatatataagtttattataaattttaccaataaaaacaatgcttagtacacaatttacaaataaaaatatataattttattgt

SEQ ID NO: 57955 - DNA, 376 bp, Homo sapiens
  misc_feature 1, 29, 118, 184: n = A,T,C or G
ntagccgtttcataaaatctggactcgcnttttaatgatccgctattataagcttcttaatagcatgaaaattgttaggctatataacattgccacttcaactctaaggaatattttngagatatccctttggaagaccttgcttggaagagcctggacactaacaattctacaccaaattgtntcttcaaatacgtatggactggataactctgagaaacacatctagtataactgaataagcagagcatcaaattaaacagacagaaaccgaaagctctatataaatgctcagagttctttatgtatttcttattggcattcaacatatgtaaaatcagaaaacagggaaattttcattaaaaatattggtttg

SEQ ID NO: 57956 - DNA, 335 bp, Homo sapiens
  misc_feature 2, 14: n = A,T,C or G
gngcttagtatttnaacctgaacattgaaacagttttcctccttgtctttcttaacagtaatagtcattatatttacctgttttttaacacaatgtatgtgatagtcaaaaaatcacagtttttcatcattattcatcttctgtacccacgcataaccactatacatagtttcttttgtacttgaatatacaaaacatgaacacagtgccatatgaataatttcacatacagaacctttttttctctgaagtcctgtggacttgcaaatatatatatatattgctttgttaatttgtttttatatttcatatatgtaataaaggaatatgatctg

SEQ ID NO: 57957 - DNA, 248 bp, Homo sapiens
  misc_feature 2, 4, 247, 248: n = A,T,C or G
tnanggccgaggaatactcctgcatacaaaggagctattgccaaatagctaccactactaagtacctactataattgtgctacaattttgcaaagtaagtattattatctcttttaaattgtgaagaaacttagtatcaaagagattaggaaactttcctaacaccatatagttagtaagtggcaaaactggtttgtctgaatcaaagctcttgctctttcttctatgccatactgcccttgtgccnn

SEQ ID NO: 57958 - DNA, 498 bp, Homo sapiens
  misc_feature 2, 4, 49, 50: n = A,T,C or G
tntnttatggagcggggaagtcgctgaaacccacaggccacaagcagtnnagtattatataagcggaaagccaatgatgagagcaatgagcattccgatgtgattgatagtcaggaactttccaaagtcagccgtgaattccacagccatgaatttcacagccatgaagatatgctggttgtagaccccaaaagtaaggaagaagataaacacctgaaatttcgtatttctcatgaattagatagtgcatcttctgaggtcaattaaaaggagaaaaaatacaatttctcactttgcatttagtcaaaagaaaaaatgctttatagcaaaatgaaagagaacatgaaatgcttctttctcagtttattggttgaatgtgtatctatttgagtctggaaataactaatgtgtttgataattagtttagtttgtggcttcatggaaactccctgtaaactaaaagcttcagggttatgtctatgttcattctatagaaga

SEQ ID NO: 57959 - DNA, 484 bp, Homo sapiens
  misc_feature 8, 33: n = A,T,C or G
gaaggccncagcaacgcggaggaaacgggattnaacggagagcgtagtgaccatcatgagcctcctcaacaagcccaagagtgagatgaccccagaggagctgcagaagcgagaggaggaggaatttaacaccggtccactctctgtgctcacacagtcagtcaagaacaatacccaagtgctcatcaactgccgcaacaataagaaactcctgggccgcgtgaaggccttcgataggcactgcaacatggtgctggagaacgtgaaggagatgtggactgaggtacccaagagtggcaagggcaagaagaagtccaagccagtcaacaaagaccgctacatctccaagatgttcctgcgcggggactcagtcatcgtggtcctgcggaacccgctcatcgccggcaagtaggggccgcctgtctgttgacagaactcactcctctgtcctatgaagaccgctgccattggtgttgagaataat

SEQ ID NO: 57960 - DNA, 173 bp, Homo sapiens
  misc_feature 25: n = A,T,C or G
gtgaattccacagtccatgaatttnacagccatgaagatatgctggttgtagaccccaaaagtaaggaagaagataaacacctgaaatttcgtatttctcatgaattagatagtgcatcttctgaggtcaattaaaaggagaaaaaatacaatttctcactttgcatttagtc

SEQ ID NO: 57961 - DNA, 461 bp, Homo sapiens
  misc_feature 5, 15, 32: n = A,T,C or G
gagcnggcataactncccattaccatattgtnttgataaacacctgtatgtagtctacaatatgaggatttaataaattgctgtcttaggtaccaaaaatatttctgcgaagggccttctttgtgccttctttgtgtttctgtagttatgcagctctgatagccgacacttctttgtgttttgtagttatgcagccctgatagccgactggccggtggtggtcttgggcatgtgcaccatgttcatcgtagtctgtgccttggttggagtattagtgccagagctccctgacttctctgatccattgctggtaactaacttttatgttttctttagcctaaaatcatctccaaatattgtgtattttaatacatgttgcattatgttatttagtaacccatttctttaaaaaccttctcaagcaacaattctctttctgaaaagtaaagacatgactttat

SEQ ID NO: 57962 - DNA, 467 bp, Homo sapiens
  misc_feature 32, 33: n = A,T,C or G
tacaacaagtacatcaaagattacatgaaatnnatcaaagggaaacttgaagaacagagaccagaaagagtaaaaccttttatgacaggggctgcagaacaaatcaagcacatccttgctaatttcaaaaactaccagttctttattggtgaaaacatgaatccagatggcatggttgctctattggactaccgtgaggatggtgtgaccccatatatgattttctttaaggatggtttagaaatggaaaaatgttaacaaatgtggcaattattttggatctatcacctgtcatcataactggcttctgcttgtcatccacacaacaccaggacttaagacaaatgggactgatgtcatcttgagctcttcatttattttgactgtgatttatttggagtggaggcattgtttttaagaaaaacatgtcatgtaggttgtctaaaaataaaatgcatttaaactct

SEQ ID NO: 57963 - DNA, 420 bp, Homo sapiens
  misc_feature 4, 27: n = A,T,C or G
accncgggagcgtgaggaaagccgtgntttgcgttccaaggcatctgtgagcccgcggagtatacaccatgagcaaagctcaccctcccgagttgaaaaaatttatggacaagaagttatcattgaaattaaatggtggcagacatgtccaaggaatattgcggggatttgatccctttatgaaccttgtgatagatgaatgtgtggagatggcgactagtggacaacagaacaatattggaatggtggtaatacgaggaaatagtatcatcatgttagaagccttggaacgagtataaataatggctgttcagcagagaaacccatgtcctctctccatagggcctgttttactatgatgtaaaaattaggtcatgtacattttcatattagactttttgttaaataaacttttgtaat

SEQ ID NO: 57964 - DNA, 489 bp, Homo sapiens
  misc_feature 1, 30: n = A,T,C or G
natatcgttcttcaagacacttgctctaancggaatggaaatgtgggcaagactgtctttgaatatagaacacagaatgtggcacgcttgcccaccatagatcttgctcctgtggatgttggcggcacagaccaggaattcggcgttgaaattgggccagtttgttttgtgtaaagtaagccaagacacatcgacaatgagcaccaccatcaatgaccaccgccattcacaagaactttgactgtttgaagttgatcctgagactcttgaagtaatggctgatcctgcatcagcattgtatatatggtcttaagtgcctggcctccttatccttcagaatatttattttacttacaatcctcaagttttaattgattttaaatatttttcaatacaacagtttaggtttaagatgaccaatgacaatgaccacctttgcagaaagtaaactgattgaataaataaatctccattttcttcaatttattt

SEQ ID NO: 57965 - DNA, 500 bp, Homo sapiens
  misc_feature 2, 15: n = A,T,C or G
tnatggaccgggggntcgcatttttcctaattgcccttttttccttctgtatttttaaagaaggatgttaatttttgactatatattttaaaaaaatctaagcagggggacatgcaaaaacaatcatcatccacttggatgtcattttatagattaacactgtgtgcttttgtatggaaaaaatatatataatttaatagtataaaaaataaaatatatattcatttgcacttacgtgaaacacaaactttgctctacaaaatttcgtgtttcttagtgattttaaaatgcatgtattgcatgtaaaggaaaaccattacaattaatgtttatcacacctttatcttggtctttgttgatttgggttttgttggggtttttgttactgtttttaaattacagtaggcttctatatatcctggatttctgaactggtcttgttgacaaggattcccaagaaatggatcttttcactggctgactctcccatatctgcaaga

SEQ ID NO: 57966 - DNA, 500 bp, Homo sapiens
  misc_feature 10, 15, 35: n = A,T,C or G
acttggaacncaggnaccccgctgtttcttatggnccgggtaatcccaactaaataacttctgcacagcatttgtaagctatttgcagactacagaatgggagaaaatgtttacaaactgcatctgacaaagatctaatccagaatctataaagaactcaaacaaatcaacaatgagaaaaacaaccccattaaaaactgggcaaaggccatgaatagacctttctcaaaagaatacatacatgtggcaataagcatatgaaaaaaatggttaatatcgctaatcattaaggaaatgcaatcaaagccacaatgagataccatctcagacctgtctgaatgggtattatcagaatgggtattattaaaaaatcaaaacatagatgctagtgaggctgcagagaaaagcaaatacttatacactgctggtgggaatgtaaattaattcagccattgtggaaagcactgcagcgatttctcaaagacataaaagcacatagc

SEQ ID NO: 57967 - DNA, 500 bp, Homo sapiens
  misc_feature 3, 6: n = A,T,C or G
gancgntatagtttttgcaaaattatttatagcttcatatgatgttttgtaattttttctattgatacctgttttaaaaatattttccaaggaagttgattaaaattatgtttgttaccttttagaaaaagcattgaaatgagtttctcttgctttttcattttccctctgctttatatgctcttcgcaatacatcatgtccaacgggatacctattgttctcatgacacccaaaattgatgagagcaaaggggtcgcaccatatggaaatgttgaaaactattgtaaagtagtattatgaagtagcttttgtgtcattcatgtcgatgacatgaaagtgaagtaaatttattctatgtaaattcacactaaaaccagtacagtaccataagtagaatacatgtaagaatcacctagtcttcactatattgagtaaatataacatgctaattttacaattaatgaaactaaacttttaaacatctccattatatctacat

SEQ ID NO: 57968 - DNA, 486 bp, Homo sapiens
  misc_feature 1, 36: n = A,T,C or G
naagtccccccttgcaacgcactctgcaggcattgnaaaggggtcggaagtgaatggagtaaacacctgacagcagcgagctgggattgagaacaaaagagcacacacaggacaatagaaaaatctgaaaaacaagtggttctcctcttctggactttgaggttataaggaggctgactaaaaacttgggtttacattaatgtcttcagatggcccgtactttggaaccactagcaaagaagatctttaaaggagttttggtagccgaacttgtaggcgtttttggagcatattttttgtttagcaagatgcacacaagccaagatttcaggcaaacaatgagcaagaaatatcccttcatcttggaagtttattacaaatccactgagaagtctggaatgtatggaatcagagagctagatcaaaaaacatggttgaacagcaaaaattagatagtctcgctttgtcgccaggctggagtacagg

SEQ ID NO: 57969 - DNA, 497 bp, Homo sapiens
  misc_feature 18, 42, 43, 57, 61: n = A,T,C or G
gccacctcggtttctganggagcggggtggcccataactgannaagtacacacgagnattntcgaatcattacaggtcctgaaataaaatacactaggatttctactggaggtggagaaacagaagaaactctgaagaaattgttacaagaagacacacccgtgaggaagttgcaagccaacaaaaaagttcaaggatctagaagacgattaagggaaggtcgttctcagtgaaaatccaaaaaccagaaaaaaatgtttatacaaccctaagtcaataacctgaccttagaaaattgtgagagccaagttgacttcaggaactgaaacatcagcacaaagaagcaatcatcaaataattctgaacacaaatttaatatttttttttctgaatgagaaacatgagggaaattgtggagttagcctcctgtggtaaaggaattgaagaaaatataacaccttacaccctttttcatcttgacattaaaagttctggct

SEQ ID NO: 57970 - DNA, 353 bp, Homo sapiens
  misc_feature 12, 16, 28, 29, 31, 32, 33, 55, 56, 57: n = A,T,C or G
gaactcgttacntggnggggcggggaanncnnnatgcaactttttcttacctttnnnagtacaggatcacagcataaaagcaatcataagataaaacatcaaactacccagcaacctgagaagcacagagtgttaaagcctccaccgtgtggagaaactaaattagggtaactagctattgagtatattgagtaccttcaaagcactcaactgacaggttttacagactggaaattataatacttatgacatttctaccttttatataacccataatctaccatagaatgtagtatttttaaagctattaacaagcaatatattaaaataataatgtattatatctgtttccg

SEQ ID NO: 57971 - DNA, 100 bp, Homo sapiens
  misc_feature 2, 5, 31: n = A,T,C or G
gnccnctccttcctctgaacttctttaggantcactgcttgtgtggttcctgggacacttaaccaatgccttctggtactgccattcttttttttttttt

SEQ ID NO: 57972 - DNA, 445 bp, Homo sapiens
  misc_feature 22: n = A,T,C or G
gtaaaaccttgaaaatcagatnctaactggatttgtatgcaactaagtatttttctgaacacctatgcaggtcttatttacagtagttactaagggaacacacaaagaattacacaacgttttcctcaagaaaatggtacaaaacacaaccgaggagcgtatacagttgaaaacatttttgttttgattggaaggcagattattttatattagtattaaaaatcaaaccctatgtttctttcagatgaatcttccaaagtggattatattaagcaggtattagatttaggaaaacctttccatttcttaaagtattatcaagtgtcaagatcagcaagtgtccttaagtcaaacaggttttttttgttgttgtttttgctttgtttccttttttagaaagttctagaaaataggaaaacgaaaaatttcattgagatgagtagtg

SEQ ID NO: 57973 - DNA, 357 bp, Homo sapiens
  misc_feature 32, 33: n = A,T,C or G
gaactccccaacagtgactggcctcaacactnntgtatgtctgagcactaccataacctaacgaagtgaggaaggaggaggcaaattggtatttttaaacaagaatttaagtggctctttctttcaagtctaaaaaaacctttggctttaaagattataaactgatttactaaatttataaaagaccttaatttagcaaagagcttctttttcctttggttcagttactcaaaatccactgtgtgaaggaataatgtatccatcattcagcctttatagcggtcttccggtagcgaagtactgtcactgttacccatatatttaaagccagcatgatcacaaaacgtagaagaactg

SEQ ID NO: 57974 - DNA, 365 bp, Homo sapiens
gaagacgggagaaactgcggatcccaaactgttccctttttctttcttgaaatgttaccactacagacatttttttaaggtgaataaacagttgtgatgtgctgtacttaaaatcatgtttaatcgtataaggaaacatttcaatacacttatacaggaagaaaactatagatgaagtacatgtgtgtgattcagtctgattcacagaattctgagagtaatatggaataaaacaactccacttagatgataactgaagcatttcctgccttgtgaaaatttggattttaaattgctgttagaatgggaaatttggacactttatatcattgtataatttcagaatttagtttctgtatcttttg

SEQ ID NO: 57975 - DNA, 371 bp, Homo sapiens
  misc_feature 16, 31, 32, 34, 267, 308, 312, 325, 359, 363: n = A,T,C or G
aacgcctgcccatggnaggcgtccagcgagnntnccgctggatgctaagtccgatgtcaccaaccagcttgtagattttcagtggaaactgggtatggctgtgagctcagacacttgcagatctcttaagtatccttacgttgcagtgatgctaaaagtggcagatcattcaggccaagtaaagaccaagtgctttgaaatgacgattccacagtttcagaatttctacagacagttcaaggaaattgctgcagttattgaaacggngtgaagacggattctttgggtgataaattgctatcattctnaagncatgggcttcacntttcgggcaccaaaacttaataagggtgggaccntttnttgaaagg

SEQ ID NO: 57976 - DNA, 113 bp, Homo sapiens
atcaggacatcccgatggtgcagccgctattaaaggttcgtttgttcaacgattaaagtcctacgtgatctgagttcagaccggagtaatccaggtcggtttctatctacttc

SEQ ID NO: 57977 - DNA, 197 bp, Homo sapiens
ctcaggcttatgaaacaaactaattcctaatagttggaaatgaattaaaagcttgcggtgagataaaagatagattttggctggatgtgatgactcatgcctgtgatccctacactttaggagggcacagcaggaggatcgcctgagcccaggaattcaagaccagcctggtcaacatagcaagactctctctctgc

SEQ ID NO: 57978 - DNA, 348 bp, Homo sapiens
  misc_feature 5, 6, 29, 32, 34: n = A,T,C or G
agagnngggttttgccatgttgtccaggnttntntggaattcctgggctcaagcaatctgccctgtccttccaaagtgctgggattactggcgtgagctaccacccctacttgaggtttctcttaataaatattttgcttagtgtcctggtgaacccagttgtcattaagagccatttgcctcctgccttggttagtaggtggaggaaatagatgcctcatatgctctgtaaggaaagcagggctgggtgcagtaactcacacctgtaatcccagtgatttgggaggccaaggtgagagtattgcttgaggccaggagtttgataccagcctgggcaaccccatttac

SEQ ID NO: 57979 - DNA, 484 bp, Homo sapiens
  misc_feature 5, 27: n = A,T,C or G
atccnagtcctgattaaagaagcaagnttaactgctgagcaagcttcaaaaccgaaagtacctccaaaatctgaaaaagaaaatgatcctctgcgaacaccggaggctttgcctgaagaaaagaagattgaatatagattgttaaaggaagagattgccaaccgtgagaaacagcgtttgattaaatcagatcagctgaagacaagttcatcatccccagcaaactctgatgtggaaattgatggtattggcaggatagcaatggttactaagcaggttacagatgcagaatcaaaactgaaaaaacataggattctcttgatgaaagatgaatctgttttaaagaatttagtgcaacaagaagctaagaagaaagaatctgttagaaatgctgaagcaaagattacaaaacttacagaacagcttcaagcaactgaaaaaattcttaatgttaacagaatgtttttgaagaagcttcaggaac

SEQ ID NO: 57980 - DNA, 472 bp, Homo sapiens
  misc_feature 1, 5, 30, 32: n = A,T,C or G
ncccncgcagcatcgcttgcagccttgctntntgtgtgggctgggaggtctggtaccggctgagcttgcaagaggatcaacatgcctttggctagagatttactacatccgtccttggaagaggaaaagaaaaaacataaaaagaaacgcctagtacaaagtccaaattcttactttatggatgtaaaatgtccaggttgctacaagatcaccacggttttcagccatgctcagacagtggttctttgtgtaggttgttcaacagtgttgtgccagcctacaggaggaaaggccagactcacagaagggtgttcatttagaagaaagcaacactaatgattcaaacagcttcctgaattttgtgttgtctcacagaaagccttatcataaattccataattctaattaatttaccaagataatgtaattacatttggttttgtaaggtatacagcagtaatctcctattttg

SEQ ID NO: 57981 - DNA, 122 bp, Homo sapiens
  misc_feature 6, 112: n = A,T,C or G
attcancaagagagaacactttatccccaagcagtacgtacaacatgtggtagagtatagtaagtgaaatgtatgctgcttatgtacacttagtattcaatttattccaggngctcttattt

SEQ ID NO: 57982 - DNA, 500 bp, Homo sapiens
  misc_feature 2, 16, 49, 51: n = A,T,C or G
tnttatggccgagganttcgccccagtacgatgccgcgcgtggcagtantnctgaggaagcaaaggagcctgctgaagctgacatcactgagctctgccgggacatgttctccaaaatggccacttacctgactggggaactgacggccaccagtgaagactataagctcctggaaaatatgaataaactcaccagcttgaagtatcttgaaatgaaagatattgctataaacattagtaggaacttaaaggacttaaaccagaaatatgctggactgcagccttatctggatcagatcaatgtcattgaagagcaggtagcagctcttgagcaggcagcttacaagttggatgcatattcaaaaaaactggaagccaagtacaagaagctggagaagcgatgagaaacttatttctatgggacagagtcttttttttttaatgtggaagaatgtcttataaaacctgaatcctgaggctgatgaattgtgaaaattcct

SEQ ID NO: 57983 - DNA, 297 bp, Homo sapiens
catgttactgaaattccagaaagaaggaataggtttgaactttaataaggtttggacagacagccagaattacattccaacctatggtgttgaaagatgtactgtgggtcatggcaatgacaaggccagagaaagtcctgtgcctttttatacttagtccagggacattgatttctctacctaccaagggaaaagagaggaaaatgtttaggtgcattctcaggtttttagtttgccaccatcaataggggtagatagtgagcggaagaggtttgtggtgtcgtgacaaaaaaaagg

SEQ ID NO: 57984 - DNA, 310 bp, Homo sapiens
tcaagcaaagctgcaaattaaaaacaagcaaacatacaaaagccactagagttcatatagaaaacatcagtgtgataaatgatattttgctggaactaaattgctggcgttgggtttaatacacctactatttgtatgttttatgcttcactttctgtcctcttgattcttttgactttgaacaatactggaagcatatcttaagtctttcttcaagttatcgtaggattaatcgtttttggtaaataagcttgtttaactactaatccattagtttgaggggctgataaatttaatagtgcaccacaat

SEQ ID NO: 57985 - DNA, 265 bp, Homo sapiens
  misc_feature 29, 30: n = A,T,C or G
gtaaccaatggtgattttatttatttttnntctctggaaaaggagataatacaatctccagaaagtgaactcatatttctaaggttaagattcccttttattgcacctagaatagtgctatgcacagagcgggtgcttgagttgttgtcgttttttgtttgttttttaaatgtaaactggtaaattttgtgcttatcttcaaggctggcttaagtataaaattgttttttaaacacttgaaaaattaaaggatttgttttatatt

SEQ ID NO: 57986 - DNA, 464 bp, Homo sapiens
cagccgcagtcttggaccataatcctggtggacatgatggacttgcccaggtcgcgcatcaacgccggcatgctagctcaattcatcgacaagcctgtctgcttcgtagggaggctggaaaagattcatcccaccggaaaaatgtttattctttcagatggagaaggaaaaaatggaaccatcgagttgatggaaccccttgatgaagaaatctctggaattgtggaagtggttggaagagtaaccgccaaggccaccatcttgtgtacatcttatgtccagtttaaagaagatagccatccttttgatcttggactttacaatgaagctgtgaaaattatccatgacttccctcagttttatcctttagggattgtgcaacatgattgatcttgatggattttcatacgattgtaaatgagctatattaaagtctattaaaggaagcccttcttgtttgaggg

SEQ ID NO: 57987 - DNA, 179 bp, Homo sapiens
cacatctacttgcttaaattgtgggcaaaagagaaaaagaaggattgatcagagcattgtgcaatacagtttcattaactccttccctcgctcccccaaaaatttgaatttttttttcaacactcttacacctgttatggaaaatgtcaacctttgtaagaaaaccaaaataaaaattg

SEQ ID NO: 57988 - DNA, 432 bp, Homo sapiens
  misc_feature 24: n = A,T,C or G
gactaataaagaaaaagagaagantcaaatagacgcaataaaaaatgataaaggggatatcaccaccaatcccacagaaatacaaactaccatcagagattactacaaacacctctacgcaaataaactagaaaatctagaagaaatggataaattccttgacacatacactctcccaagactaaaccaggaagaagttgaatctctgaatagaccaataacaggagctgaaattgtggcaataatcaatagcttaccaaccaaaaagagtccaggaccagatggattcacagccgaattctaccagaggtacaaagaggaactggtaccattccttctgaaactattccaatcaatagaaaaagagggaatcctccctaactcattttatgaagccagcatcatcctgataccaaagctgggcagagacac

SEQ ID NO: 57989 - DNA, 497 bp, Homo sapiens
  misc_feature 6, 34: n = A,T,C or G
ataccnttttcaaaccgaaactctgtattgtttnagaatatacaagaagctacaagtggctgctttacaactgcccagaaaagggtatacagcttgatggagaacaactcttatcctcgtttcttggagtcagaattctaccaggacttgtgtaaaaagccacaaatcaccacagagcctcatgctacatgaaatgtaaaagggagcccagaaatggaggacatttcattctttttcctgaggggaaggactgtgacctgccataaagactgaccttgaattcagcctgggtgttcaggaaacatcactcagaactattgattcaaagttgggtagtgaatcaggaagccagtaactgactaggagaagctggtatcagaacagcttccctcactgtgtacagaacgcaagaagggaataggtggtctgaacgtggtgtctcactctgaaaagcaggaatgtaagatgatgaaagagacaatgtaatacctgttggt

SEQ ID NO: 57990 - DNA, 106 bp, Homo sapiens
  misc_feature 24: n = A,T,C or G
catgttttgtgtatataaaagggngggtttttttaaaaatacattcccagattatccttgtaatgacacgaatctgcaataaaagccatcagtgctatttggatgt

SEQ ID NO: 57991 - DNA, 500 bp, Homo sapiens
  misc_feature 16, 17: n = A,T,C or G
caggtcattgctgatnnaacccattctgtttgaccggaattcagccatcaagagcagcattgtccctgaggtgaaggactatgctgctattgtggaacagaacttgcggcattttaaaccagtgtttcagctgctggagaagcagatactgtcccgagtccggaacacagctagctttaggaagactgctgaacgcctgctgagattttcagataagagacagactgaggaggccattgacaggatttttgccatatcacagcaacagcagcagcaaagcaagtcaaagaaaaaccgaagggcaggcaaacgctataaatttgtggatgctgtccctgatatttttgcacagattgaagtcaatgagaaaaagattagacagaaagctcagattttggcacagaaagaactacccatagatgaagatgaagaaatgaaagaccttttagattttgcagatgtaacatacgagaaacataaaaatgggggcttgattaaag

SEQ ID NO: 57992 - DNA, 488 bp, Homo sapiens
  misc_feature 24: n = A,T,C or G
acaacaagtgattgtccagggtgnccatgagctctatgatctggaggagactccagtgagctggaaggatgacactgagagaacaaatcgattggtcctccttggcagaaatttagataaggatatccttaaacagctgtttatagctactgtgacagaaacagaaaagcagtggacaacacatttcaaagaagatcaagtttgtacataacactagaggcatttcttatcaaaaggattggataataaaaataagtttctactgggtatatttcaagcatttatttattactttagttacgaattccaatatactttaaaatggtatttgttttacagcatacataaaatgtagcaaatcggtactgtaaaacatttaacattcatacagttatatataatatccttttttttaaagaatggtatttcacaaaaatgtcttttgaaattggctttggagtttacatatactgaacatgaaagtttat

SEQ ID NO: 57993 - DNA, 500 bp, Homo sapiens
gtagcaaggttccacagaaaaaagcaaaacttgctgctgatgaagatgatgacgatgatgatgaagaggatgatgatgaagatgatgatgatgatgattttgatgatgaggaagctgaagaaaaagcgccagtgaagaaatctatacgagatactccagccaaaaatgcacaaaagtcaaatcagaatggaaaagactcaaaaccatcatcaacaccaagatcaaaaggacaagaatccttcaagaaacaggaaaaaactcctaaaacaccaaaaggacctagttctgtagaagacattaaagcaaaaatgcaagcaagtatagaaaaaggtggttctcttcccaaagtggaagccaaattcatcaattatgtgaagaattgcttccggatgactgaccaggaggctattcaagatctctggcagtggaggaagtctctttaagaaaatagtttaaacaatttgttaaaaaattttccgtcttatttcatttctgtaaca

SEQ ID NO: 57994 - DNA, 272 bp, Homo sapiens
cggcccgacgagctccgctttcgctacagcatggtggcctactggagacaggctggactcagctacatccgatactcccagatctgtgcaaaagcagtgagagatgcactgaagacagaattcaaagcaaatgctgagaagacttctggcagcaacgtaaaaattgtgaaagtaaagaaggaataatctaccctgactaaagcttgaaatgctacatttccaaggtgaagatgtgtgggcacatgttatggcagattgaaaaggatctcatt

SEQ ID NO: 57995 - DNA, 473 bp, Homo sapiens
  misc_feature 6: n = A,T,C or G
gagccntgaggcagccagcgcaggggcttttgctgagggggcaggcggagcttgcggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgat

SEQ ID NO: 57996 - DNA, 360 bp, Homo sapiens
  misc_feature 6, 31: n = A,T,C or G
gattcngtttcaaaaaacccccagtgtattntaaggcaataattcctatacgaagcaaactaaaatgcagcaatattaaggtataaaaacaaagaggaataattccattgaaccttgattctggaaactttgatccacccagcagtcatgatgttagactcattgaaaagaatgtatttctaatgcatgatgcgatcggtctatagatgtgtcatggaaacttggttgcaacttcaagacaaaataaaaagtaaacatttacatgaaaaatggtggatatggaaggtggagaagagaggagataacagctttatctttcaaaatagagaattgagagatggtaccaaaagctgatgaagt

SEQ ID NO: 57997 - DNA, 488 bp, Homo sapiens
  misc_feature 6, 8, 21, 34: n = A,T,C or G
gaagtncnctggaggcgaagnaacgcaaaccttntaacatggacgttaatatcgccccactccgcgcctgggacgatttcttcccgggttccgatcgctttgcccggccggacttcagggacatttccaaatggaacaaccgcgtagtgagcaacctgctctattaccagaccaactacctggtggtggctgccatgatgatttccattgtggggtttctgagtcccttcaacatgatcctgggaggaatcgtggtggtgctggtgttcacagggtttgtgtgggcagcccacaataaagacgtccttcgccggatgaagaagcgctaccccacgacgttcgttatggtggtcatgttggcgagctatttccttatctccatgtttggaggagtcatggtctttgtgtttggcattacttttcctttgctgttgatgtttatccatgcatcgttgagacttcggaacctcaagaacaaactggagaat

SEQ ID NO: 57998 - DNA, 172 bp, Homo sapiens
tcatgcactgtgccttcaaaatgaaatttttaaaagggactttaaatgaagttgaatagtagtttttaaaagtcaatttgtaatttatgcgaaatctaactgtaatgaggtcctttctgttttttatatgtaaacagatctactaatcctgtataaaagttattttacgatt

SEQ ID NO: 57999 - DNA, 284 bp, Homo sapiens
  misc_feature 177, 180, 213, 230, 238, 275: n = A,T,C or G
gtctcagaactgaataactgcagcgacttgatgctctaaaacagtgtaggatttaagaatagatggtttttaatcctggaaattgtgattgtgacccatgagtggaggaactttcggttctaaagctgataaagtgtgtagccagaagagtacttttttttttgtaaccactgtctnganggcaaaataattatggtaaaaaacaagtctcgngtttattattccttaanaactctgngttatattaccatggaacgcctaataaagcaaaatgnggttgttcc

SEQ ID NO: 58000 - DNA, 488 bp, Homo sapiens
  misc_feature 6, 31: n = A,T,C or G
cacccnggtgagcaagggcacctgcgagctngtccttccatagtgacgccccccaaggacatctggaatgtcactggtgcccaggtgtacttgagctgtgaggtcatcggaatcccgacacctgtcctcatctggaacaaggtaaaaaggggtcactatggagttcaaaggacagaactcctgcctggtgaccgggacaacctggccattcagacccggggtggcccagaaaagcatgaagtaactggctgggtgctggtatctcctctaagtaaggaagatgctggagaatatgagtgccatgcatccgattcccaaggacaggcttcagcatcagcaaaaattacagtggttgatgccttacatgaaataccagtgaaaaaaggtgaaggtgccgagctataaacctccagaatattattagtctgcatggttaaaagtagtcatggataactacattacctgttcttgcctaataagtttctttt

SEQ ID NO: 58001 - DNA, 138 bp, Homo sapiens
  misc_feature 27, 29, 125: n = A,T,C or G
cccataaagaaactatgatgtggagantngactaacatctcctccaataaaccccaaatggttaatccaactgtcagatctggatcgttatctactgactatattttcccttattactgcttgcngtaattcaactgg

SEQ ID NO: 58002 - DNA, 375 bp, Homo sapiens
  misc_feature 12, 42, 69: n = A,T,C or G
tatggaccgggnctggtccctgtggtttctcctacaagtganattttaggtatctgccttggtttcagnggggacatctggggcttatggggctgggatgaggagctggatgattctaggaaggcccaagttggagaatgatgtggagagtgtgccaagacactgcttttggcattttattcctttctgtttgctggatgtcaattgacccttttattttctcttacttgtgttttcagatattgttaatcctgccagtctttctcttcaagccagggtgcatcctcagaaacctactcaacacagcactctaggcagccactatcaatcaattgaagttgacactctgcattaaatctatttgccatttctgga

SEQ ID NO: 58003 - DNA, 300 bp, Homo sapiens
atattggcatgtttagatgtcaggcttagtcttctgaagatgaagttcagccattttgtatcaaacagcacaagcagtgtctgtcactttccatgcataaagtttagtgagatgttatatgtaagatctgatttgctagttcttccttgtagagttataaatggaaagattacactatctgattaatagtttcttcatactctgcatataatttgtggctgcagaatattgtaatttgttgcacactatgtaacaaaacaactgaagatatgtttaataaatattgtacttattggaagt

SEQ ID NO: 58004 - DNA, 483 bp, Homo sapiens
  misc_feature 30, 57: n = A,T,C or G
attgcctacttcaggaaatagactaataantatttttacactcttgtgattatttangaattatcaggccttttggaaacagtgtatggaaattggcaattgttgagtggttgtgctatgaaattttgatacaattttgaagtactataacaatgagtagcagttatacttcttattttgtctttgaaatgttattcttttacacatccttataacctttattttttatgagagagtaatgacaaaaaaactctattgaaataaatttaataactaaaatatttcctagctttcagcttatgtggagaagtcgctgtgaagccacctataaatccatttactgaatttatggagaaggctgtaaatgatggaagtcattcagaagaactcttttgccatcttaaaactatatcagagaaagaagatttaccacggtgtaccagtgaaagtcatctcagctggtattctcatcagtatcagggg

SEQ ID NO: 58005 - DNA, 398 bp, Homo sapiens
  misc_feature 25: n = A,T,C or G
taatggtccagcgtttgacataccnacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttcgtgctgtaagacctaaagttcttatgagattgtccaaaacaaagaaacatgtcagcagggcctatggtggttccatgtgtgctaaatgtgttcgtgacaggatcaagcgtgctttccttatcgaggagcagaaaatcgttgtgaaagtgttgaaggcacaagcacagagtcagaaagctaaataaaaaaatgaaacttttttgagtaataaaaatgaaaagacgctg

SEQ ID NO: 58006 - DNA, 487 bp, Homo sapiens
  misc_feature 6, 7: n = A,T,C or G
cactanncgtaggaaattacctgattggcattttaatgtgtgagtcaaatgtttttaggttaataaaagaaacgtttgatacatggtttaaaaaaaaagtgtcggggtagcctgctgtcccctaagagtaacagacacttgcctttgcaaatagattacaaaaaaaaggtctttcctctcttcatttatcattttaatatgcaagctgttaatattgaagtagatgtttgttttccacattctaaaattactgagatttctgtttaacgtttcactttgcctttcttcttcacttaccaattggaagctttcctgataaatggatgagagccaagcagtttatataacctgaagatgattgaatttcagctttgtgagaatgaggaaacatgcatgtgttgcaggccaggccttaaaaggatgcttataaaccaaaataattctatgctggaaaaacctgttggctttggtgctttaagttctttgt

SEQ ID NO: 58007 - DNA, 135 bp, Homo sapiens
caataccagttactgaaactagaaaccaatgaattccaacaacttcaaagtaaaatcagtttaatttcagaaaagtacgacggatttcaggtttagtaactgatgtaatatcattgacagattctgtgcaagaac

SEQ ID NO: 58008 - DNA, 285 bp, Homo sapiens
cgccgctgtggctctaaggcctaccaccttcagaagtcgacctgtggcaaatgtggctaccctgccaagcgcaagagaaagtataactggagtgccaaggctaaaagacgaaataccaccggaactggtcgaatgaggcacctaaaaattgtataccgcagattcaggcatggattccgtgaaggaacaacacctaaacccaagagggcagctgttgcagcatccagttcatcttaagaatgtcaacgattagtcatgcaataaatgttctggttttgaaaaaac

SEQ ID NO: 58009 - DNA, 350 bp, Homo sapiens
  misc_feature 5, 21: n = A,T,C or G
catanccagaaatgcaaatgnaaaaccacaatgtttataccatctcataccagtctgaatggccattattaaaaagtcaaaaaacaacagatgctggtgaggttgtggagaaaagggaacacttatacactgttagtaggagtagacatttgtccaactattgtgaaaagcagtatggtgattcctcaaagagctaaaagcagaactaccagttgactcaacaattctattactggatatatacccagaggaatataaattgaccttacggtgtttctaccataaagacacatgcatgtgaatgttcattgcaacactattcacaattgcaaagacatggaattaacctt

SEQ ID NO: 58010 - DNA, 129 bp, Homo sapiens
  misc_feature 62, 86, 104, 121: n = A,T,C or G
gcaccctactcttgctggtaaaatcactggcatgttgttggagattgataattcactaactnacttcatatgctcgaggtctccanagctcactccgttctaangtgtgatgaagctgtanctgagcta

SEQ ID NO: 58011 - DNA, 468 bp, Homo sapiens
  misc_feature 24: n = A,T,C or G
tgttgttgttttcagcctgctgcngctgctgctgttgcggctaggggaaccgtcgtggggaaggatggtgtgcgaaaaatgtgaaaagaaacttggtactgttatcactccagatacatggaaagatggtgctaggaataccacagaaagtggtggaagaaagctgaatgaaaataaagctttgacttcaaaaaaagcaagatttgatccatatggaaagaataagttctccacttgtagaatttgtaaaagttctgtgcaccaaccaggttctcattactgccagggctgtgcctacaaaaaaggcatctgtgcgatgtgtggaaaaaaggttttggataccaaaaactacaagcaaacatctgtctagatgtattgatggaatttctggctttctaaatgattttactttctgccttgaattttcaaggcatagatgtcaacttacagaataacatgttttaagat

SEQ ID NO: 58012 - DNA, 177 bp, Homo sapiens
cctgctctctcccaggaattctcatgtgggattccccttgccaggccggcctttggatctctcttccaagcctttcctgacttcctcttagatcatagattggacctggttttgttttcctgcagctgatgacttgttgccctgaagtacaataaaaaaaattcattttgctccagc

SEQ ID NO: 58013 - DNA, 296 bp, Homo sapiens
  misc_feature 9: n = A,T,C or G
gaaaaaccnttacttttgaattttctctgcttttatccaatccacctgaaagataaaagggaacaataatatcagaattctgctttgaatagtaaagatacatttgaaatttaaggatgatacagtgacttaccatttcagcttgtgccctgaatataaatgtagcctccggaagtagcagatggcagccaccagaaatgaaactgccaacatcacaaagccttttgccattctccagacagtgtctaaggcttggcttgtagctagcatccaggagtgaacttggtcacttccta

SEQ ID NO: 58014 - DNA, 417 bp, Homo sapiens
  misc_feature 1, 29: n = A,T,C or G
nactcctgaaaaataccactctagtttanatctagaaaaccatccttaatcctatctaccttaaaaaatggtggaaatatctttttaataaataaaatggccctttgtttatcttttttctagactaggatggcaaatacaagacactaatgctgctccccttcccttccaatactatgaaatcctctctaaaaatatcctcaaaatctttcttggtatagtgccctaggcagccattactaacgctgattggaattgactccgaaggtaaaacctatttggcacttttgctctaggcagtgttcaatttttttgtcagttttgtttagtttttggggtgttcctatgcctgagtgggattcttcttttggaaattggaaatagttgcatagtggtttttaacatgaattaaatagg

SEQ ID NO: 58015 - DNA, 483 bp, Homo sapiens
  misc_feature 9, 21, 463: n = A,T,C or G
ccttcaggnaagttgtgccanaccctagattgtgaaggacccactgttcttctgttgtacgagctccctgaaccattgttcagaggaccaatgtcacatcgcttcatgggcatggcccatggagcatctgggtgatatctgtctacagtattggctcttctgcgaggctgatacacaaggcctctcttccacatgatcatttgcaaacctcccccagcccctaccatccaatgtggaaggaaaacaagaactgcctgaagaagagtccaagctacagatacacagcgtgtgcattgcggctgtcaccttcctcctcccacttctgtatcctcagagatgctgcgtggatgtttccttaacctcagctgacttccctgtgaatgtctaatgctagttcagggcctccaggcattgatttgtacagtggtaactcccaatgaggcttctgttatcatttgggggngctttctctgtcattaaaag

SEQ ID NO: 58016 - DNA, 122 bp, Homo sapiens
  misc_feature 119, 120: n = A,T,C or G
gtacgcaattctcgattctttgaagagatgacaacaaattttggttttctactgttatgtgagaacattaggccccagcaacacgtcattgtgtaaggaaaaataaaagtgctgccgtnncc

SEQ ID NO: 58017 - DNA, 459 bp, Homo sapiens
  misc_feature 27: n = A,T,C or G
gccttcctgaagctgacagcattcggnttcgagatgtctcgctccgtggccttagctgtgcccgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaaattctgcttgcttg

SEQ ID NO: 58018 - DNA, 219 bp, Homo sapiens
gagcagtcagaagacctggtcgtcgtcttgactttggcaaatgagccggagccccttgggcaggtcacacaacctgtcccagcgagggacaccgagtggcccttcatgtacatccatggtgtgctggcttaaaatgtaattaatcttgtaaatatactcctagtaatttaagattttgtttttaaactggaaataaaagattgtatagtgcatgttttc

SEQ ID NO: 58019 - DNA, 309 bp, Homo sapiens
  misc_feature 2, 42, 45: n = A,T,C or G
anggagcgggcatgccctggtagctgacaaaacaaaaaaacnttnaaattttagcaaactaacacaggcaacagaaaaccaaataccacatgttctcacttataggtgggagctaaaggataagaacttataaacacaaagaaggaaacaacagacactggagtctacttgaaggggagggtggggggagagaggggaacagaaaagctaactatttggtactgggcttaatacctggatgatgaaataataagttcaacaaacccccgtgacacgtgtttacctgtgtaacaaaccatatgtacccct

SEQ ID NO: 58020 - DNA, 228 bp, Homo sapiens
  misc_feature 191: n = A,T,C or G
cttgttctaatcttgtcaaccagcgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggngctataataaataaacttcaacactctttatgacaac

SEQ ID NO: 58021 - DNA, 490 bp, Homo sapiens
  misc_feature 3, 30, 56: n = A,T,C or G
ganacccatggaacatttcttataacgtgntcactttgacttgagcaaatggtttnatttttatcttaaaaatcagttaagaatatataaaatcctactttggccaagtttgtttcttttcattatagtttatatgaaaagatcaccttaagtgaaattattttcctttaatcttttatgtatttattcacttctggaagctaggaatgagcaacacaaattttactctgaagtcagaagagctcatatataataattctaatgtcccacctattttcacttgtccattccatgtaccagcttagttatgatacttagtcacataattatctttgataaaggtagaggcacaaagaggcaaactaagcaagtcaaattctaatgtgtgtacttcataataattttttatccattttcatctttatattctgtaacatgaaacttacctaatcttcaaatgttagcttcattttttacctttgaaatactt

SEQ ID NO: 58022 - DNA, 314 bp, Homo sapiens
gtggtagcaaagaaggatcctgtctttggtaaatttgggtgtaattatgagtttaatgtatgcctttttggcagtatcctttctggcttcatcatgctatatccccattgtccacaacattgactggtgcttagtaaggtgctcaaggacgcatcaaatgaatgaacaaagactagagacagagttgcctggccttattctttaaatacccacactataggactgcaacaaaatacagagccctagtgattagaagacttcaaaagtgtgttttctttttccaggtgcatgcctttgatttcttgagatgatgg

SEQ ID NO: 58023 - DNA, 500 bp, Homo sapiens
  misc_feature 14, 18, 27: n = A,T,C or G
gcccatttgtcttntgtngtcttgctnttaaatatcccctgtgcaacccaccctcggttgaggatcacaaattgaggtgccttccttgtatgctttttgttagtattttttgtttttgttccttaactgctgagcctcagccagcgtgggtcctgggggaaataccattccaaaggaagccatccctatggggaaattggttttactgggtaaattaatacttttatttcttcccctatcccttccttcctagttgtgataaacatgggagaggagtgactttgactgctggggaatttcctcctaagaaccttattcccaaaataagccagggattatgtcaaggcttctttcaaggaggctcataaaagcagtgacctcatccggggctttggatagagtgagaattccccaactaaattggacttctctgctttatccccttctcttccttcaccatctgcactacatttctggctgatcccaatcagattcccgct

SEQ ID NO: 58024 - DNA, 414 bp, Homo sapiens
  misc_feature 23, 33, 58: n = A,T,C or G
gaagaacatgtactttttaaatnatgttccctntaaacatggctgttaacccactgcntgcagaaacttggatgtcactgcctgacattcacctccagagaggacctatcccaaatgtggaattgactgcctatgccaagtccctggaaaaggagcttcagtattgtggggctcataaaacatgaatcaagcaatccagcctcatgggaagtcctggcacagtttttgtaaagcccttgcacagctggagaaatggcatcattataagctatgagttgaaatgttctgtcaaatgtgtctcacatctacacgtggcttggaggcttttatggggccctgtccaggtagaaaagaaatggtatgtagagcttagatttccctattgtgacagagccatggtgtgtttgtaataat

SEQ ID NO: 58025 - DNA, 488 bp, Homo sapiens
  misc_feature 4: n = A,T,C or G
ctcncgcgaaattgggtctcttcctattccggcgctcggcaagttctcccaggagaaagccatgttcagttcgagcgccaagatcgtgaagcccaatggcgagaagccggacgagttcgagtccggcatctcccaggctcttctggagctggagatgaactcggacctcaaggctcagctcagggagctgaatattacggcagctaaggaaattgaagttggtggtggtcggaaagctatcataatctttgttcccgttcctcaactgaaatctttccagaaaatccaagtccggctagtacgcgaattggagaaaaagttcagtgggaagcatgtcgtctttatcgctcagaggagaattctgcctaagccaactcgaaaaagccgtacaaaaaataagcaaaagcgtcccaggagccgtactctgacagctgtgcacgatgccatccttgaggacttggtcttcccaagcgaaattgtgggcaaga

SEQ ID NO: 58026 - DNA, 445 bp, Homo sapiens
  misc_feature 30, 31, 33: n = A,T,C or G
atcgcccagtcctaaagaagaacccactgnntnacttgagaatcatgttgaagctaaacccatatgcaaagaccatgcgccggaacaccattcttcgccaggccaggaatcacaagctccgggtggataaggcagctgctgcagcagcggcactacaagccaaatcagatgagaaggcggcggttgcaggcaagaagcctgtggtaggtaagaaaggaaagaaggctgctgttggtgttaagaagcagaagaagcctctggtgggaaaaaaggcagcagctaccaagaaaccagcccctgaaaagaagcctgcagagaagaaacctactacagaggagaagaagcctgctgcataaactcttaaatttgattattccataaaggtcaaatcattttggacagcttcttttgaataaagacctgattatacaggcagtgagaaagc

SEQ ID NO: 58027 - DNA, 288 bp, Homo sapiens
gccccaggtagacctggcaccatgaggattacagacagtggaatcttactgtcatctggacagctgttttcctgtttggatggtaaaggaagttgagagtctttagacctgtgcacagccccgcaccaaggggtgctgtatgctctaggcatcccctcccccaggggattttctaagtagatggggggacacggtgaactggctgtgtccatctttgtcactgagtgaaatctctgttttctattctctgagaagataagtttgtatgttctgagaataaatacacga

SEQ ID NO: 58028 - DNA, 409 bp, Homo sapiens
  misc_feature 12, 15: n = A,T,C or G
gaccggggaaanacnctaacattggaactcactgcacatgattcttagcttctttaatcagactttgtgacttaaaagtttgggggttttctttgaaagtttccagccctattcagaaagcaactcttggctgtgtgcatttttcaactccaagcagcccaggggtaagtaaacaaagtatggatgaaggtcagattttcttgtcagtttctgagaaacctggcagcctgctgttaacaacacaggccagtattgggttttattgaatttggtatgtgaccaaggtcggcctaaaggatggcgcaggtcctgggcaggaaagaatttttccttttatcacataactgtaatatttggttgctcagcataagtgatggaagcaaacactaatttctaataaaattgtgtt

SEQ ID NO: 58029 - DNA, 393 bp, Homo sapiens
  misc_feature 2, 3: n = A,T,C or G
gnngagcctgcaaaagttggagaaggtgtggcagtcctcatttctgtggaatctgaagaagcccacgcagattttaattcccactctagattctgtatctagatcaccatggcgactggacagaagttgatgagagctgttagagtttttgaatttggtggaccagaagtcctgaaattgcgatcagatattgcagtaccgattccaaaagaccatcaggttctaatcaaggtccatgcatgtggtgtcaaccccgtggagacatacattcgctctggtacttatagtagaaaaccactcttaccctatactcctggctcagatgtggctggggtgatagaagctgttggagataatgcatctgctttcaagaaaggtgacagagttttcact

SEQ ID NO: 58030 - DNA, 416 bp, Homo sapiens
  misc_feature 12, 31: n = A,T,C or G
gaattcctgaanctgacagcattcgggccgngtatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaaga

SEQ ID NO: 58031 - DNA, 314 bp, Homo sapiens
actctgatttgacgcacagttatcgtgaagggccccagaggaaccctgcggagggacttcaatcacatcaatgtagaactcagccttcttggaaagaaaaaaaagaggctccgggttgacaaatggtggggtaacagaaaggaactggctaccgttcggactatttgtagtcatgtacagaacatgatcaagggtgttacactgggcttccgttacaagatgaggtctgtgtatgctcacttccccatcaacgttgttatccaggagaatgggtctcttgttgaaatccgaaatttcttgggtgaaaaatacat

SEQ ID NO: 58032 - DNA, 383 bp, Homo sapiens
tgcttcctggcctgattgaggagatggaaaatttttgcaaaaaacaaggtgttgtggtcttccatccagtttcttaagtgctgatgataaaagtgaattagacccaccttgacctggcctacagaagtaaaggagtaaaaataaatgcctcaggcgtgctttttgattcatttgataaacaaagcatcttttatgtggaatataccattctgggtcctgaggataagagagatgagggcattagatcactgacagctgaagatagaagaacatctttggtttgattgtttaaataatatttcaatgcctattctctgcaaggtactatgtttcgtaaattaaataggtctggcccagaagacccactcaattgcctttgagat

SEQ ID NO: 58033 - DNA, 459 bp, Homo sapiens
  misc_feature 29: n = A,T,C or G
ctccagtggcttcgtcttcggtttttttnttccttcgctaacgcctcccggctctcgtcagcctcccgccggccgtctccttaacaccgaacaccatgccttcaattaagttgcagagttctgatggagagatatttgaagttgatgtggaaattgccaaacaatctgtgactattaagaccatgttggaagatttgggaatggatgatgaaggagatgatgacccagttcctctaccaaatgtgaatgcagcaatattaaaaaaggtcattcagtggtgcacccaccacaaggatgaccctcctcctcctgaagatgatgagaacaaagaaaagcgaacagatgatatccctgtttgggaccaagaattcctgaaagttgaccaaggaacactttttgaactcattctggctgcaaactacttagacatcaaaggtttgcttgatgttacatgcaaga

SEQ ID NO: 58034 - DNA, 463 bp, Homo sapiens
  misc_feature 5, 6, 31, 33, 367, 420: n = A,T,C or G
agganncacaggggaagaaattgaagatacntnttctttctattctttcctttcttcagccctggatgtgactgaatctggtttctgttggcaatatagagtttcatttttaaatttatttttgaagacatcttgcacataatttttttattatactttaagttctagggtacatgtgcacaacgtgcaggtttgttacatatgtatacatgtgccatgttggtgcttgcacataatttttatcctaaatttaaaaaattgtatttagtgatttatcttactatagtaaatagtcgcaaaggatcctcacagctaaaagggatataaatgcctctgaagagaggtgaaaacaaacttggaggaaggnggcaaaataaatgtcaaagatcttcctttcccatataatctctcttttatggntttttccttaatgcaggatattcataactaagaaaagtaaatg

SEQ ID NO: 58035 - DNA, 424 bp, Homo sapiens
  misc_feature 5: n = A,T,C or G
gtganctgaagctttaagtctcatccagctttctaatgccaggttgctgtagggtaacttttgaagtagatatattacctggttctgctatccttagtcataactctgcggtacaggtaattgagaatgtactacggtacttccctcccacaccatacgataaagcaagacattttataacgataccagagtcactatgtggtcctccctgaaataacgcattcgaaatccatgcagtgcagtatatttttctaagttttggaaagcaggttttttcctttaaaaaaattatagacacggttcactaaattgatttagtcagaattcctagactgaaagaacctaaacaaaaaaatattttaaagatataaatatatgctgtatatgttatgtaatttattttaggctataatacatttcctat

SEQ ID NO: 58036 - DNA, 409 bp, Homo sapiens
  misc_feature 2, 5, 29: n = A,T,C or G
cnccnatagtatatagtaccgcaagggantttatgaaaaattataaccaagcataatatagcaaggactagcccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtagg

SEQ ID NO: 58037 - DNA, 433 bp, Homo sapiens
  misc_feature 30: n = A,T,C or G
caacccttgctggtgacagcaaaaatgacncaccaatggaagcggctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccct

SEQ ID NO: 58038 - DNA, 438 bp, Homo sapiens
  misc_feature 3, 4: n = A,T,C or G
ctnncagcggggatctgatgaaaaggtcatactgaaacgccttgcacggctgctcggcttgatcacagctccctaggtaggcaccacagagaagaccttctagtgagcctgggccaggagcccacagtgcctgtacaggaaggtgcctggccatgtcacctggctgctaggccagagccatgccaggctgcgtccctccgagcttgggataaagcaaggggaccttggcgctctcagctttccctgccacatccagcttgttgtcccaatgaaatactgagatgctgggctgtctctcccttccaggaatgctgggcccccagcctggccagacaagaagactgtcaggaagggtcggagtctgtaaaaccagcatacagtttggcttttttcacgttgatcattttttatatgaaataaaaaagatcctgcatttat

SEQ ID NO: 58039 - DNA, 437 bp, Homo sapiens
  misc_feature 5, 6, 31: n = A,T,C or G
gaaanntatatgactgagcgtagcatacagnttaacctgcagaaacagtacttaggtaattgtagggcgaggattataaatgaaatttgcaaaatcacttagcagcaactgaagacaattatcaaccacgtggagaaaatcaaaccgagcagggctgtgtgaaacatggttgtaatatgcgactgcgaacactgaactctacgccactccacaaatgatgttttcaggtgtcatggactgttgccaccatgtattcatccagagttcttaaagtttaaagttgcacatgattgtataagcatgctttctttgagttttaaattatgtataaacataagttgcatttagaaatcaagcataaatcacttcaactgctcttctgtagttcttggatttcttttcccttttgactttgaataaatgtaaaatcctttcag

SEQ ID NO: 58040 - DNA, 482 bp, Homo sapiens
  misc_feature 1, 32: n = A,T,C or G
naactcctgtgttatgaatcacatgaaagctngaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgaggggccaaatgagactgagggaagaaaaaaaatctctttttttctggaggctggcacctgattttgtatccccctgtagcagcattactgaaatacataggcttatatacaatgcttctttcctgtatattctcttgtctggctgcacccctttttcccgcccccagattgataagtaatgaaagtgcactgcagtgagggtcaaaggagagtcaacatatgtgattg

SEQ ID NO: 58041 - DNA, 475 bp, Homo sapiens
  misc_feature 6, 7: n = A,T,C or G
gaggcnntgaggcagccagcgcaggggctttttgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgat

SEQ ID NO: 58042 - DNA, 498 bp, Homo sapiens
  misc_feature 12, 22, 63: n = A,T,C or G
ccccttatggcncgggtaaccnccaactatgttaagggtaatgatatattcagttaaccaagnaccaacatggtgtctgcttggttgatgcttgaagtaaggtgacctggccccagccacccgggtggccaggagctgaaaggactgtaacaagtaggcagtgaatagtcttcaaacttgttacttgcatacctccctacaaattttggaaaaaccatgagactctgattgattttttaaaagaatatctaaaatcattatgtttaaatagcctcaaaagaagcattttattatgtattgtaaatattggcattttaaaatgttattcggtcttttaaatgtatccagtgaaatgttggtacaatagagttttgatagctaccattttccatttttaaaaatactttaacacgctttgtaacagttggaaatattgtttgattccttttgcttcctgaactccattcttcttcttctgaagaattttatcctaaaatg

SEQ ID NO: 58043 - DNA, 500 bp, Homo sapiens
  misc_feature 7, 8, 30, 34: n = A,T,C or G
actcacnnaaaaactctatggagtggcgtntatntggaaaggccttcattcataggtcctctctcattcaccatcagaaaatccatactggagagaagccttatgaatgtagagaatgtgggaaagctttctgctgtagctcacaccttactcgacatcaaagaattcacactatggagaaacaatatgaatgcaacaaatgtctgaaagtctttagtagcctctcatttcttgttcagcatcagagtattcatactgaagaaaaaccctttgaatgtcagaaatgcaggaaatccttcaaccagcttgaatcactgaatatgcatttgagaaatcacattagattgaaaccctacgaatgcagtatatgtgggaaagcctttagtcataggtcatccctgcttcaacatcacagaattcatactggagagaaaccttatgaatgtattaaatgtgggaagaccttcagctgtagttcaaaccttaccgtacatcagaga

SEQ ID NO: 58044 - DNA, 492 bp, Homo sapiens
  misc_feature 3, 8, 30, 32, 54: n = A,T,C or G
aanacccnaaatttgtgtgcttacaggaantntttcagacagcgatccccaggngttccctttggtttatcagtgtttaatttgatgaatgccatcatgggaagtggcatccttggcttagcttatgttatggctaataccggtgtctttggatttagcttcttgctgctgacagttgctctcctggcttcttactcagtccatcttctgcttagtatgtgtattcagacagctgtaacatcttatgaagatcttggactctttgcatttggattacctggaaagttggtggtggcaggcaccataataattcagaatattggagctatgtcatcttatcttttaattattaaaacagagcttcctgctgctattgcagaatttttgactggagactatagtagacatataaaatgaagttgttgagccagatgatctctaaggtctcttccagctctaacattccataactgtgattctgagttactgctg

SEQ ID NO: 58045 - DNA, 196 bp, Homo sapiens
  misc_feature 1, 3, 30, 31, 32, 33, 58: n = A,T,C or G
nanacccctttgcttgtattttgtattaannnnataagaaaaagaagcctttattgtngagcatgttggcattgtcccctttatttttttctctttttgggacatatgaagcaagttattctttttctgtatctttttttcttttgtaaacttttttttgttttgtttaaaaatggctttataaaagggcttttat

SEQ ID NO: 58046 - DNA, 455 bp, Homo sapiens
  misc_feature 29: n = A,T,C or G
attcctgaagctgacagcattcgggccgngtatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcaccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttg

SEQ ID NO: 58047 - DNA, 277 bp, Homo sapiens
  misc_feature 30: n = A,T,C or G
aaccccattttggccttcataagtatgctntaaaactaaagtgatcactgctattcacgaattattatagaatcttctttgcagattttgtgatatattaagaaaagctgattttaatattaatatttaagaagttatttgatcctgaaaacctaaatttaaggtataggccatttgacacgtcctttttgaacagaaatttcattacaggctaagtgaaaataagccagaattagcatgagtcaggtagaaattcatgataaaagaacaaccagac

SEQ ID NO: 58048 - DNA, 408 bp, Homo sapiens
  misc_feature 4, 5: n = A,T,C or G
aganncaggaaactagacaaatgctagtgtgttttaactagctaaacaaaactaagttaaatgaacatttaaaagtttccctagcgggccattccttagcaaaatgttggaatccctgttgctacattgactaaaaggtcatgatgaatggaatatgtaagacttggctcatagaaacctaatcagatggttagaggtgttggcagtttaggacctgctgtcataaatgtgtgaacaaccttttgtaacctaacctattgacctgcatgttttttctttaccccaattcattacatggaggctcaatcttgagtttgctttactggttcagcaaaagccaggaagaacaactttgtagtaatcaaaatgttatccaactgtatattgtttactttattgtaaatactg

SEQ ID NO: 58049 - DNA, 262 bp, Homo sapiens
  misc_feature 3, 9, 31, 33: n = A,T,C or G
aanacgccnaaccccactaaaacactcaccntntatctcaacccctgacccccatgcctcaggatactcctcaatagccatcgctgtagtatatccaaagacaaccatcattccccctaaataaattaaaaaaactattaaacccatataacctcccccaaaattcagaataataacacacccgaccacaccgctaacaatcaatactaaacccccataaataggagaaggcttagaagaaaaccccacaaaccccattact

SEQ ID NO: 58050 - DNA, 464 bp, Homo sapiens
  misc_feature 21, 29, 31, 34: n = A,T,C or G
aatctacgagtcccaggagangaaaaaancnttntacgttgataaaacttataaatttcattgattaatctcctggaagattggtttaaaaagaaaagtgtaatgcaagaatttaaagaaatatttttaaagccacaattattttaatattggatatcaactgcttgtaaaggtgctcctcttttttcttgtcattgctggtcaagattactaatatttgggaaggctttaaagacgcatgttatggtgctaatgtactttcacttttaaactctagatcagaattgttgacttgcattcagaacataaatgcacaaaatctgtacatgtctcccatcagaaagattcattggcatgccacaggggattctcctccttcatcctgtaaaggtcaacaataaaaaccaaattatggggctgcttttgtcacactagcatagagaatgtgttgaaatttaactttg

SEQ ID NO: 58051 - DNA, 314 bp, Homo sapiens
tcatgcctgtgatcctagcactttgggaggccaaggtgggaggatcatttgagctcaggagttcaagattagcctgggtaacatagtgagaccctgtctctattaaaaaataataataaaaataacattcacattggtattgttcactaaggtattggttgttaaggcattcattaaggtattgttaaaacttgtgttaagcatgttaaagtctcagtaactttgggatagaaataaaatgtgataaaaagctgaaagaaaccaccacaagggagagtcctttttgaaatattagagacataatgctgtctaat

SEQ ID NO: 58052 - DNA, 486 bp, Homo sapiens
  misc_feature 2, 10, 32, 35, 57, 77, 79: n = A,T,C or G
cntacctggnccgcagggaacccccggccacntanggcccgggccagaacgcaagangggggaggaggcagtaatantnaagattgaagtattttgctggaataagttcaaattcttctgaactcaaactgaggaatttcacctgtaaacctgagtcgtacagaaagctgcctggtatatccaaaagcttttattcctcctgctcatattgtgattctgcctttggggacttttcttaaaccttcagttatgatttttttttcatacacttattggaactctgcttgatttttgcctcttccagtcttcctgacactttaattaccaacctgttacctactttgactttttgcatttaaaacagacactggcatggatatagttttacttttaaactgtgtacataactgaaaatgtgctatactgcatactttttaaatgtaaagatatttttatctttatatgaagaaaatcacttaggaaatg

SEQ ID NO: 58053 - DNA, 451 bp, Homo sapiens
  misc_feature 3, 6, 417: n = A,T,C or G
gcnagntttaagtagattctatttccttggttctccctctccctgaggacctcttattttattgtcccctcttctaggttaattctcctttgatttgactttgttgagaaggaggttggacagtagattagcaaagttccaagtgcaaaattacagtgtgttagagtgtggggggaaaattagtcttatttttccctacatgggatacaacactgtgaattcaatcttcaactgaaggccctgcagttctcctaaaacatagttgtttgtttttctttaacaaagtttaagctagtgttaataaattaaaaaaaattgcttgtctgtctacttcagctttgttttatgcccatttcatattgttgtctgtgttgtaattcataacttttgataccatttctgatgtgtaaaattggntgtcttgtaaatatcttataaagagttcaattgt

SEQ ID NO: 58054 - DNA, 262 bp, Homo sapiens
  misc_feature 2, 6, 7, 58: n = A,T,C or G
angacnnggtttactggtaaattatgttatttttttacaactaattttgtactctcancaatgtttgtcatatgcttcttgcaatgcatattttttaatctcaaacgtttcaataaaaccatttttcagatataaagagaattacttcaaattgagtaattcagaaaaactcaagatttaagttaaaaagtggtttggacttgggaacaggactttatacctcttttactgtaacaagtactcattaaaggaaattgaatga

SEQ ID NO: 58055 - DNA, 178 bp, Homo sapiens
gcattggatacagcagtagacattttaacaagaagatgaatggcgtccgtgggttgctaactgaactttgaagacccgctacaaaacgcgcagatgtgcagcagattggaaggagacacagatgttcggtttttttcctgtttctgaaaagaaataataatatccaggtcaacagatt

SEQ ID NO: 58056 - DNA, 267 bp, Homo sapiens
ataataccgagttacttcccaaaaatgttaatttcagctggattgaaagagtatttgggaaatgtggcaatgttgtttatataagtataccacattataagtctactggagatccaaagggatttgcgtttgtggaatttgaaacaaaagaacaagcagcaaaagcaattgagtttcttaacaacccaccagaagaagcaccaagaaaacctggcatatttcctaaaacagtgaaaaataagcccattccagccttaagagttgtgg

SEQ ID NO: 58057 - DNA, 382 bp, Homo sapiens
  misc_feature 4, 32: n = A,T,C or G
agangccagcaagggactggtgtctctggtgngaggtgggtttgatgtatctctgtcctatgctggtctctcttctcctttataaaatcctctgtggtcaactgactactgcgtatcgcagtggaataagactgcacagttgctggtaggtgagtttaaagtcttaatctatgcattcagagaaatatttttatatgctttgtgtaatttataacaaggatttttttttagctttgttaactgtgaattcacccctcctcctccactgcatatttaaagcatgtgttcacactgtgtgtaaacattcactgaagattttttctttgtgcattgctgactgttcaaacataacaagtattattaaaattaaatattaactggc

SEQ ID NO: 58058 - DNA, 499 bp, Homo sapiens
  misc_feature 15, 38, 40, 348: n = A,T,C or G
agggccgggaggacncgatccatgtttccagcatggcntnttagccctttttacttccctacttcaagaggaaatgaccttcctgtcactccctttttctctgatattactctcaagtaatattgaacttattgctttgttctttactctggcctttccttttgttcgacaaggtcaaggaccttgttttgttggttcacctttatttccctagtgcctgggacagtgtctagcacatagctattcaataaatatgcattaaataaatgattagatgattaaatgaataacatcctcataacaataaaaatagttaatatttttgacataaattgatataaagtgggnttagaagttggtatgaacaataaggccttaatagagagataattaaccttgatagtatatgaaaaaacaaatgctggattatagagcatctaaaggatatagttagctacatgaatgcacaaacacttttctatttagttttgcttttgga

SEQ ID NO: 58059 - DNA, 456 bp, Homo sapiens
  misc_feature 11: n = A,T,C or G
gattcccgaanctgacagcattcgggccgatatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttg

SEQ ID NO: 58060 - DNA, 488 bp, Homo sapiens
  misc_feature 6: n = A,T,C or G
gaggcncaattactctcttcctattggtttacagtagaaggctcagtttctctgctcatcacacggccttcggcactgtagctttgggtggtgggctgcagattaattttgtaaccaccttaagaaaaatacggaactctaactccttgccactcaagaaatgtcctccctttcagaatatgccttccgcatgtctcgtctcagtgcccggctatttggtgaagtcaccaggcctactaattccaagtctatgaaagtggtgaaactgtttagtgaactgcccttggccaagaagaaggagacttatgattggtatccaaatcaccacacttacgctgaactcatgcagacgctccgatttcttggactctacagagatgagcatcaggattttatgggatgagcaaaaacgactaaagaagcttcgtggaaaggagaaaccaaagaaaggagaagggaaaagagccgcaaaaaggaaatagtggttg

SEQ ID NO: 58061 - DNA, 451 bp, Homo sapiens
  misc_feature 1, 6, 7, 8, 34, 58, 448: n = A,T,C or G
nagaannngttcatttctgagctctccattctgntctttcatcagtttatctttgtgncagtatcacattgtttatgttctgtagcttttaactctagattttattgacattttgtgaaaaatgaaattttttgacccctgagcaagaatatgttgaagagtgtgtttcatatacacagttttgaatttgccagtttgacttttgcttttaattcctagtttcattcagtttttattagaaaacacacagtgtgtaattttagtcttttttaaatgattgtttttgttgttttgaggcaagattttactgtcacctcgtgtgaagtgcagtggcataattttggctctctgtagcctcagcctcctgggctcaagtgatccttttacctcagttttctgagtagctaggactacagatacgcactagatgtctgtttaatgggttggnttg

SEQ ID NO: 58062 - DNA, 459 bp, Homo sapiens
  misc_feature 32: n = A,T,C or G
gaaacccggtggtggccactgcgcagaccttncttcgctcgtactcgtgcgcctcgcttcgcttttcctccgcaaccatgtctgacaaacccgatgtggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggcagggaaggaaagaacttgcatgttggtgaaggaagaagtggggtggaag

SEQ ID NO: 58063 - DNA, 259 bp, Homo sapiens
gcaggtctctccgctcatcaagctcggccgctactccgccctgttcctcggtgtggcctacggagccacgcgctacaattacctaaaacctcgggcagaagaggagaggaggatagcagcagaagagaagaagaagcaggatgaactgaaacggattgccagagaattggcagaagatgacagcatattaaagtgagtgaccctgcgacccactctttggaccagcagcggatgaataaagcttcctgtgttgtgtggt

SEQ ID NO: 58064 - DNA, 161 bp, Homo sapiens
  misc_feature 6, 17: n = A,T,C or G
aaaagnaggattgattngagcattgtgcaatacagtttcattaactccttcccccgctcccccaaaaatttgaatttttttttcaacactcttacacctgttatggaaaatgtcaacctttgtaagaaaaccaaaataaaaattgaaaaataaaaaccctc

SEQ ID NO: 58065 - DNA, 473 bp, Homo sapiens
tgttctggttccagtcaagcaaacttattcagcaccagttcctcatgccatgcacctgctgtcacccagcatgcaccctattttaagggtacagccgttgtcaatggagagttcaaagacctaagccttgatgactttaaggggaaatatttggtgcttttcttctatcctttggatttcacctttgtgtgtcctacagaaattgttgcttttagtgacaaagctaacgaatttcacgatgtgaactgtgaagttgtcgcagtctcagtggattcccactttagccatcttgcctggataaatacaccaagaaagaatggtggtttgggccacatgaacatcgcactcttgtcagacttaactaagcagatttcccgagactacggtgtgctgttagaaggttctggtcttgcactaagaggtctcttcataattgaccccaatggagtcatcaagcatttgagcgtcaacga

SEQ ID NO: 58066 - DNA, 478 bp, Homo sapiens
  misc_feature 29, 209: n = A,T,C or G
cacaccgaaacttttctcttttttgcacntttcctgcaagccaagctacatcagttgctaatatgcttggttccacatgtcacacttgatttctgatccttttacccacttctcaaaaatggttaggaaatatttatatggatttctttggctagactttaagataaattactttttggtgaagttcttaatcctttttttttcaaagngcctgatctcttagagcaagcttacaaacaaaagcccacaagcgacaccctagactaatgtgcaagttaacactgaagaagagttagaaagcacgccttgatacaataataataataagtgcaggtggggaaatgtctataataagaactttatatatatgaatatattcaatcctaacaacagccttgaagaaaatattattattaaacccgttttacagttcaaaaaaactaaggctgagaaaggaaagaaactggtccaaagtcat

SEQ ID NO: 58067 - DNA, 296 bp, Homo sapiens
  misc_feature 20, 170, 198: n = A,T,C or G
aaattttttttttctgatcncaaaaacaatgtatattgattataggaaaataagaaaactatttttaaaagaagaaaaattactcatcatttcaccactgtttggaatattaaggaaaaagtaaatgtttcttccttcaccttccctcaatatcatttgattcatttagngactacatatttactgagcacgtactgngtgccaaacataaaactgaagatccttgccacaagccatctacgttccagtagaaggaacttatatacataatacacatagtaaataggtaaatattt

SEQ ID NO: 58068 - DNA, 384 bp, Homo sapiens
  misc_feature 5, 7, 30, 184, 303, 383: n = A,T,C or G
aatancnagatgagagagttctcttagtanttttttctttgtaaggaagggttattccggggaagtgttggaaaaaagattagggcagggtacccttagtttatatagggtacaaaagaatgggaaacatcttccctttcttctttaatctctgaagtcatgtttggaattacatataatgtancaggtactggagaggacctgaatttcaagcttctgatttagctgtttgtaaacttccaagttttgcttgactaaagaatgctgatcttttttgggagtctgatctccttctaatatcanaaagtgctttttatattccagattgcttgaattaaactgtttggattaaagaacatatatgggagttccctctctggggnt

SEQ ID NO: 58069 - DNA, 482 bp, Homo sapiens
  misc_feature 29, 33, 40, 58: n = A,T,C or G
aatacccattggaagttctggccaggacntttngaccagnaggaagaaataaagggtnttcaaacaggaaaagaggaattcaaattgttcctgtttgcagatgacatgattgtatatttagaaaacaccattgtctcagccccaaacctccttaagctgataaacaacctcagcaaagtctcaggatacaaaatcaatgtgcaaaaatcacaagcattcctatacaccaataacagaaaaacagagccaaatcatgagtgaactcccattcacaattgctacaaagagaataaaatacctaggaatataacttacaagggatttgaaggacctcttccaagaaaactacaaaccactcctcagggaaataagacaggacacaaataaatggaaaaactttccatgctcatggataggaagaatcaatatcctgacaatggccatactgcccaaagtaatttatagattcaatgctatcccca

SEQ ID NO: 58070 - DNA, 457 bp, Homo sapiens
  misc_feature 3, 27: n = A,T,C or G
tancactcttgtttttagtgtttgttntgcaatgcagtaattctgttttacccttttcttttgaaacactcaacttgggaaatgaaaatacagattctagtgctaatatgcttgggaaaacacagtctagattgctaatatggaccaaaaatagtgcctttgaagaaaatgaacactgttctaatctttcaacaagaacttgtagtccatggtcccattcagaagaaacacgttcagacaatgaaacattaaatattcagtttgaagaatccacacagtttaatgccgaagatattaattatgtagttcctagagtctcgtcaaattatgtagatgaagaacttctagattttttgcaagatgaaacttgccagcaaaacagtagaactttaggtgagattcctacattagttttcaaaaaaacatctaaactagaatccgtctgtggtattcagct

SEQ ID NO: 58071 - DNA, 483 bp, Homo sapiens
  misc_feature 30: n = A,T,C or G
atttccggttgattgtgcgatagaacattnttgcaggagtactgtctcatctcatcatattcacgggttctggagattaactcattgaaagggggaggggcattttcaaattctgcctaccacaggcaataactgcccatctcagctgtaggtggaatttttacccagaaaagataggccctagaagcctcatttcttttctccatggaaaaggacagccctctgctgcagcgttcaacttgtgtgtttactgacagagtgaactacagaaatagcttttcttcctaaaggggattgttctacattttgaagttattttttaataaaattgaattatgttgtgtattgtgcttcttaataggaaatgcattattggactgtttttgtaacatcctgtttattgcaaatagctagtatcgttcaaaaactgtataaaatacttttgtacatattagcaatgtctaatttgtatacacttcagtt

SEQ ID NO: 58072 - DNA, 217 bp, Homo sapiens
  misc_feature 24, 138: n = A,T,C or G
aatgatcctagtaattgcctaganatatctttctcttacctgttatttatcaatttttcccagtatttttatacggaaaaaattgtattgaaaacacttagtatgcagttgataagaggaatttggtataattatggngggtgattattttttatactgtatgtgccaaagctttactactgtggaaagacaactgttttaataaaagatttacatt

SEQ ID NO: 58073 - DNA, 276 bp, Homo sapiens
atgtggaatgaatctctactcctccctcaaaacatgtatctcaaaaatttcctgcttccaatgcatttgcttcatggccaggggaagccaagcgtccagaaagtggaagagcgggtactactaccaccccctagtggtggcatgtgacaacacggtatagcaataaaacattgaagcaaagataccaattgcacatccaacttagccaaacccaacgcagttgataaaagctgatgtgtacaaatcctgattaatttagaattaaatctgttactg

SEQ ID NO: 58074 - DNA, 498 bp, Homo sapiens
  misc_feature 101: n = A,T,C or G
cggcgccagcagttccagtccgctgctttactttttgcttcaccgacatagtcattatgccgaagagaaagtctccggagaatacagagggcaaagatggntccaaagtaactaaacaggagcccacaagacggtctgccagattgtcagcgaaacctgctccaccaaaacctgaacccaaaccaagaaaaacatctgctaagaaagaacctggagcaaagattagcagaggtgctaaagggaagaaggaggaaaagcaggaagctggaaaggaaggcacagaaaactgaatctgtagataacgagggagaatgaattgtcatgaaaaattggggttgattttatgtatctcttgggacaacttttaaaagctatttttaccaagtattttgtaaatgctaattttttaggactctactagttggcatacgaaaatatataaggatggacattttatcgtctcatagtcatgctttttggaaatttacatcatcctca

SEQ ID NO: 58075 - DNA, 485 bp, Homo sapiens
  misc_feature 55, 56: n = A,T,C or G
tactccaaaggaggtattccttgcaggttttatcaatatgatttataactgaccnnattattcaaaatcattgagtaaaatgaatacaatatttagtttaaatgtattgtaagttttatttactagtgaggttgaaataaagatgactttattcacactttcttttggactggtatagattcctggatgttgttgaagaaaaccattctagttccaaaatacagttattgggatctatggataaaccatcagtttaagaactttacttgaaccctttttctaaaataatcaatttaagcatttgcaggcttgggcaagttgcaaattaaaaaatcctatcttgttggtaaaatgaaagttgtcaatttaatgaaattgtttatatttcataataaatacatatggctgtttttgcttcattttggatataattcttgccacctttctagacagatgtcagaactttaaaaaaaaaatactacaga

SEQ ID NO: 58076 - DNA, 474 bp, Homo sapiens
  misc_feature 29: n = A,T,C or G
caagccggattgtggaataaaattgtaantttaatgtcagtataaaaggaaatattagaaacagtaggaaaaaatgaccattgtataagtctctgtctaataagccactccactactaggatttatgatagggctcccattccaatgatatagaactccctggattctcactaagtatttattccacatccagaaaacaagtatggcatggagagttaggatgtcaaatggccctctctctcaaccaagattcaggacatagctattaccttttagatccctattgatatgatttttgggggatatgttctaaaaatgtttatgattgaatcttaaatggtaatatttgtagaaatatagttaatcattacaatgtctagcttatggatgtatagtcacaatatgagggtaaatcaaatgcatttgtattcccctgcttttagagccaattattaaaaaatacaccaaaatcat

SEQ ID NO: 58077 - DNA, 310 bp, Homo sapiens
  misc_feature 123, 124, 149, 150: n = A,T,C or G
aacctaaatctgtttgtgcgtctgcatcaaaggaacatttgcttcactgggtgataacctttgatgaaatgagatatgtccaagtaacgttaactgtgaagttacacacagtagctgactttnnagtgcctgttctgtaaattttattnnaaactgttaccatagtcttaagttgtttatgctttatcagactggctaatgtgaaagcataatattatgaagtttattctgccttatgagaccttaaaaaatggatttcattttacaggctaatgttgtaacctgactagtatgtaaaataaatcattcc

SEQ ID NO: 58078 - DNA, 490 bp, Homo sapiens
  misc_feature 6, 30, 32, 59, 456, 459, 460: n = A,T,C or G
tatgcnccacatacatggagtatggaggtntnttttctgaaaaatacatttagattacntttagtttgaaggagaggtgggctgatggctgagttgtatgttactaacttggccctgactggttgtgcaaccattgcttcatttctttgcaaaatgtagttaagatatactttattctaatgaaggccttttaaatttgtccactgcattcttggtatttcactacttcaagtcagtcagaacttcgtagaccgacctgaagtttctttttgaatacttgtttctttagcactttgaagatagaaaaaccactttttaagtactaagtcatcatttgccttgaaagtttcctctgcattgggtttgaagtagtttagttatgtctttttctctgtatgtaagtagtataatttgttactttcaaatacccgtactttgaatgtaggtttttttggnggnnggtatctataaaaattgaggggaaatggtt

SEQ ID NO: 58079 - DNA, 223 bp, Homo sapiens
  misc_feature 24: n = A,T,C or G
gctttgttaaacagatgcttgaangcagcatgctcattaagagccatcaccactccctaatctcaagtacccagggacacaaccgctgcggaaggccgcagggtcctctgcctaggaaaaccagagacctttgttcacttgtttatctgctgaccttccctccactattgtcctatgaccctgccaaatccccctctgtgagaaacacccaagaatgatcaat

SEQ ID NO: 58080 - DNA, 495 bp, Homo sapiens
  misc_feature 12, 19, 31: n = A,T,C or G
actttctttganctcaggnacctctctctcntttatggcccggggaaggcccttgaggcagccagcgcaggggcttttgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatctttt

SEQ ID NO: 58081 - DNA, 414 bp, Homo sapiens
  misc_feature 31, 405, 412: n = A,T,C or G
cactcccaaaggacacttctgattaagactnttgaaactagagatggacaggttatcaacgaaacttctcagcatcacgatgaccttgaataaaaattgcacacactcagtgcagcaatatattaccagcaagaataaaaaagaaatccatatcttaaagaaacagctttcaagtgcctttctgcagtttttcaggagcgcaagatagatttggaataggaataagctctagttcttaacaaccgacactcctacaagatttagaaaaaagtttacaacataatctagtttacagaaaaatcttgtgctagaatactttttaaaaggtattttgaataccattaaaactgcttttttttttccagcaagtatccaaccaacttggttctgcttcaataaatcttnggaaaanct

SEQ ID NO: 58082 - DNA, 474 bp, Homo sapiens
  misc_feature 24: n = A,T,C or G
gctgagggggcaggcggagcttgnggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggaga

SEQ ID NO: 58083 - DNA, 421 bp, Homo sapiens
gatggagaaatgaatttcttcccactgaaggaaactctttctcattcgcagccaagacgggagtgccactgttcctctcttcactcctgagatactgcttctggaagcgggtgtcacttcctctctagtacctcttctcttctctgaagtgtgtgactatctcctagtgtttaaatttggcagttactcgccatgtatgtcagcatagaaaaggaaatgtttttaccttatctcctgcatgtatgatagaacttaaaagaaatgtgcatttgttttcatagccccagcagagaaaatcctcttcatagattaaatgtgctgctgtggacaggagggaaaaaaaaaccctctacatattgaaaggcaccaaatgtaatatctgacactgttaagatgcccaaaagagcaaagttgtagtgga

SEQ ID NO: 58084 - DNA, 179 bp, Homo sapiens
cgcatggtgctgaatggctgaggaccttcccagtctccccagagtccgtgcctttccctgtgtgaattttgtatctagcctaaagtttccctaggctttcttgtctcagcaactttcccatcttgtctctcttggatgatgtttgccgtcagcattcaccaaataaacttgctctctgg

SEQ ID NO: 58085 - DNA, 417 bp, Homo sapiens
taccaatagaagggcaatgcttttagattaaaatgaaggtgacttaaacagcttaaagtttagtttaaaagttgtaggtgattaaaataatttgaaggcgatctttaaaaagagattaaaccgaaggtgattaaaagaccttgaaatccatgacgcagggagaattgcgtcatttaaagcctagttaacgcatttactaaacgcagacgaaaatggaaagattaattgggagtggtaggatgaaacaatttggagaagatagaagtttgaagtggaaaactggaagacagaagtacgggaaggcgaagaaaagaatagagaagatagggaaattagaagataaaaacatacttttagaagaaaaaagataaatttaaacctgaaaagtaggaagcagaagaaaaaagacaagctagg

SEQ ID NO: 58086 - DNA, 210 bp, Homo sapiens
  misc_feature 23, 24, 206, 209, 210: n = A,T,C or G
aagtcaattctggtctcatttanntcagctctaaattcttttcatagaacattatttatgaacaaataatgccagaaaataagatgaattccaaaaaaatcaaggagttactatatgtgcgaagatgatttatgtgcagattttttcttattagaatggtctagggatattgattaactttggaagttgttagcaaaatataaatngcnn

SEQ ID NO: 58087 - DNA, 487 bp, Homo sapiens
  misc_feature 1, 35: n = A,T,C or G
naccgagcctctctgccctactgctgctttcaagnaccctgagactgacctgcaggacgaaaccatgaagagcctgatccttcttgccatcctggccgccttagcggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctacgccatggtttatggatacaatgctgcctataatcgctacttcaggaagcgccgagggaccaaatgagactgagggaagaaaaaaatctctttttttctggaggctggcacctgattttgtatccccctgtagcagcattactgaaatacataggcttatatacaatgcttctttcct

SEQ ID NO: 58088 - DNA, 496 bp, Homo sapiens
  misc_feature 14, 20, 147, 149: n = A,T,C or G
cctctcttcagcgnggggcncccacaatttgcgcgctctctttctgctgctccccagctctcggatacagccgacaccatgggtttcggagacctgaaaagccctgccggcctccaggtgctcaacgattacctggcggacaagatntncatcgaggggtatgtgccatcacaagcagatgtggcagtatttgaagccgtgtccagcccaccgcctgccgacttgtgtcatgccctacgttggtataatcacatcaagtcttacgaaaaggaaaaggccagcctaccaggagtgaagaaagctttgggcaaatatggtcctgccgatgtggaagacactacaggaagtggagctacagatagtaaagatgatgatgacattgacctctttggatctgatgatgaggaggaaagtgaagaagcaaagaggctaagggaagaacgtcttgcacaatatgaatcaaagaaagccaaaaaaacctgcacttgttgccaag

SEQ ID NO: 58089 - DNA, 254 bp, Homo sapiens
  misc_feature 150, 152, 241: n = A,T,C or G
ctgagggggcaggcggagcttgccgaaaccgcagataagtttttttctctttgaaagatagagattaatacaactacttaaaaaatatagtcaataggttactaagatattgcttagcgttaagtttttaacgtaattttaatagcatangnttttaagagaaaatatgaagacttagaagagtagcatgaggaaggaaaagataaaaggtttctaaaacatgacggaggttgagatgaancttcttcatgggg

SEQ ID NO: 58090 - DNA, 489 bp, Homo sapiens
  misc_feature 1, 2, 34, 58: n = A,T,C or G
nntgcccactcatgataaactgacatggtttttntgcaagaattaaatcttctatctnagagtaataatttatgatgactcagtggtgccagagtaaagtttctaaaataacattcctctcacttgtaccccactaaaagtattagtctacacattacattgaagttaaacacaaaattatcagtgttttagaaacatgagtccggactgtgtaagtaaaagtacaaacattatttccaccataaagtatgtattgaaatcaagttgtctctgtgtacagaatacatacttattcccatttttaagcatttgcttctgttttccctacctagaatgtcagatgtttttcagttatctccccatttgtcaaagttgacctcaagataacatttttcattaaagcatctgagatctaagaacacaattattattctaacaatgattattagctcattcacttattttgataactaatgatcacagctatta

SEQ ID NO: 58091 - DNA, 481 bp, Homo sapiens
  misc_feature 31, 32: n = A,T,C or G
gattcccgaagctgacagcattcgggccgtnntgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattgatatgcttatac

SEQ ID NO: 58092 - DNA, 385 bp, Homo sapiens
gggaggccaaggccagcagatcacctgaggtcaggagttcgagaccggtctggccagcatggtgaaaccctgtctctactaagggtacaaaaattagccaagagtggtggcaggcacctataatcccagctactggggaggctgaggcacgagaatcgcttgagcctgggaggcagaggttgcagtgagccaggatcgcgccactgcactctagcctgggcaatacaacaagactcagtctcaaaaaaaagtatatattaagaagtataaaaagttggccaggcacagtggcaggcaggtggatcacatgaggtcaggagttcaggagcagcttggccgacatggtgaaaccctgtctctactaaaaatacaaaaattagccagg

SEQ ID NO: 58093 - DNA, 214 bp, Homo sapiens
  misc_feature 25: n = A,T,C or G
gtctttgagaataaaggaaaaaaantcttcagatgcaatggttttgtgtagcatcttgtctatcatgttttgtaaatactggagaagctttgaccaatttgacttagagatggaatgtaactttgcttacaaaaattgctattaaactcctgcttaaggtgttctaattttctgtgagcacactaaaagcgaaaaataaatgtgaataaaatgt

SEQ ID NO: 58094 - DNA, 356 bp, Homo sapiens
aaacccagcattaaggtggacagccaaactttaagctttattcgagaacaggtgaatcagttgaatttgtgtgtaaacggggatatcgtctttcatcacgttctcacacattgcgaacaacatgttgggatgggaaactggagtatccaacttgtgcaaaaagatagaatcaatcataaagtgcacacctttattcagaactttagtattaaatcagttctcaatttcattttttatgtattgttttactcctttttattcatacgtaaaattttggattaatttgtgaaaatgtaattataagctgagaccggtggctctcttcttaaaagcaccatattaaatcctggaaaact

SEQ ID NO: 58095 - DNA, 386 bp, Homo sapiens
tccaagaccagagtctcagaactcattaagaaacagtttacttggaatggagaatacccatctgtaatacaggtcctgtcatttcattcatctcaaattattttgaattcttcccaaatggctgctggatttaggtggtaataggggctgtgggccataaatctgaagccttgagaaccttgggtctggagagccatgaagagggaaggaaaagagggcaagtcctgaacctaaccaatgacctgatggattgctcgaccaagacacagaagtgaagtctgtgtctgtgcacttcccacagactggagtttttggtgctgaatagagccagttgctaaaaaattgggggtttggtgaagaaatctgattgttgtgtgtattcaatg

SEQ ID NO: 58096 - DNA, 157 bp, Homo sapiens
  misc_feature 24: n = A,T,C or G
gctgagggggcaggcggagcttgnggaaaccgcagataagtttttttctctttgaaagatagagattaatacaactacttaaaaaatatagtcaataggttactaagatattgcttagcgttaagtttttaacgtaattttaatagcttaagatttt

SEQ ID NO: 58097 - DNA, 124 bp, Homo sapiens
  misc_feature 26: n = A,T,C or G
ctttggattataaaatatgttttacntaaagtgttttatgggcaactgaggtagagaattgggataaatttttcctttgtaaaaattagtatttaaaaaattatcaagaaatacaggtgatttt

SEQ ID NO: 58098 - DNA, 486 bp, Homo sapiens
  misc_feature 24, 461, 476, 485: n = A,T,C or G
gttgtgaggatgaagggagataanccacaatcctcagagtgtaacaaatactaaatgaaatttttcttctgatactattatttagaatgtattttttatataaaattttatataaaattaaaatttttagatattttaaaccttccaacatttacagttataggtgttgtggcactctatggctatcccattccaatggaattgaaaaggagtcaacttccaggtgcgattcacttggcagagaacatgaaagcaatttgtcctttactcttataaacagctgtttttatctagttttcgcttttgtaaagattgggaaatggagtggctctttaaatttggtttgagtcttgcttcccacgtttcttaatcccactgtgtgaaaagcagatatttagaaacgtgaaggaactcgacacctttatgtaacagaacaacacatcactttctttagattggtnggggggaacccctanggttctaang

SEQ ID NO: 58099 - DNA, 135 bp, Homo sapiens
cacgtattattgacattaatacctaatcggcgagtgcccatctgccccaccagctccagtgcgtgctgtctgtggagtgtgtctcatgctttcagatgtgcatatgagcagaattaaacatttgcctacaactcc

SEQ ID NO: 58100 - DNA, 500 bp, Homo sapiens
ctccttccagcacctcctctcttctccttttgcccaaactcacccagtgagtgtgagcatttaagaagcatcctctgccaagaccaaaaggaaagaagaaaaagggccaaaagccaaaatgaaactgatggtacttgttttcaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgcccaaaagacgttttctttggaccaaagatctctttcgtgattccttgcaacaatcaatgagaatcttcatgtattctggagaacaccattcctgatttcccacaaactgcactacatcagtataactgcatttctagtttctata

SEQ ID NO: 58101 - DNA, 453 bp, Homo sapiens
  misc_feature 24, 310, 320: n = A,T,C or G
tgatgtagcattttgtatatatgntatttaactcttggatttttgtggaactttaaatcattactataattgctgcgtttgtaatgtcatcaggtgtacacggcatagtgaaaatgtttaataggttgatatatactctcagaactataatagagaatctagttgggagacaacacttgtcaggaaaaaatcttaatcaagcctgtttaattacaaattgattttttttttaatgcttgcccatgtcaggtcaagcctagtatgcaatactgatattttgaatggaaagaaagctatcacatggttttanaatggacagngtttcattatttaatatgctgcctatgatttcaatgaaaatgagattgagggaagaatttaattaagagtctaatgttcaatagaagggtaaaaggtgatttaccaagaaaatattcggagggggaaataagg

SEQ ID NO: 58102 - DNA, 263 bp, Homo sapiens
  misc_feature 24, 261: n = A,T,C or G
ctgggggttgcagctttgtataanctttcgtgtggctgatcaaagaaagaaggcatacgcagatttctacagaaactacgatgtcatgaaagattttgaggagatgaggaaggctggtatctttcagagtgtaaagtaatcttggaatataaagaatttcttcaggttgaattacctagaagtttgtcactgacttgtgttcctgaactatgacacatgaatatgtgggctaagaaatagttcctcttgataaataaacantt

SEQ ID NO: 58103 - DNA, 119 bp, Homo sapiens
  misc_feature 23: n = A,T,C or G
ctcgtatcgccaagctcgaaaangcaaaggctaaagaacttgccactaaactgggttaaatgtacactgttgagttttctgtacataaaaataattgaaataatacaaattttccttcg

SEQ ID NO: 58104 - DNA, 428 bp, Homo sapiens
atgatagttcgtgtgacaaacagagatatcatttgtcagattgcttatgcccgtatagagggggatatgatagtctgcgcagcgtatgcacacgaactgccaaaatatggtgtgaaggttggcctgacaaattatgctgcagcatattgtactggcctgctgctggcccgcaggcttctcaataggtttggcatggacaagatctatgaaggccaagtggaggtgactggtgatgaatacaatgtggaaagcattgatggtcagccaggtgccttcacctgctatttggatgcaggccttgccagaactaccactggcaataaagtttttggtgccctgaagggagctgtggatggaggcttgtctatccctcacagtaccaaacgattccctggttatgattctgaaagcaaggaatttaatgcaga

SEQ ID NO: 58105 - DNA, 484 bp, Homo sapiens
  misc_feature 57: n = A,T,C or G
gaagcccaaacattaaactcctaaataaattttttttccatcatgcttctatagatncatatatatctatagttgtcatctgattaagtgatccagtctttgaaaatactgaagttttgaagccgacataaaatagttttaaaagctgcataacttaagcattctgtattgtgctgagtgactaaaatatccaaaaactttaaaacatcacaaatacttacttgctgcttaaaagctgtggtttgccattttctgcttagagatttttgatgtatttgcttaattctttttttaacacatttttaaaaccttatttcaggaagggaaaatgaacagaaattaaataacaacaaaatgcatttaaggaaagctttgaagagtaactcctccctcactaagggactaagaacaatggtggagcagaacttgatggagaaactggaaaccttggggattaatgcagatatacgtggcatttcaagtg

SEQ ID NO: 58106 - DNA, 186 bp, Homo sapiens
  misc_feature 25: n = A,T,C or G
aattcatactggagaaaactcccancaagtgtgacaaatgtgacaaaacatttaattaattctcataccttattgcacaggaaagcatttatacttgagaaaaattgtataaagaatggaaaagtcattaatatctgctcatatcttaacatcagcgagttggtatttaataaaagcattatcaat

SEQ ID NO: 58107 - DNA, 456 bp, Homo sapiens
  misc_feature 6, 18, 31: n = A,T,C or G
cagacnaggccttacagnaaaattgttgtgnttagaattgctggatgcatttttaccctccacacaaacctaaaaattttgtgacccctttcacttacctgaaaagtagagaaatggattcagtataaggataaggagggaaggtggaccagaatgaaaactgtaaatatttttttaacctaatatcacttaaatcgaggcagaaagatatagacattcaatgaattatattcaatgcatttaaaataccactgtaattgacagagtaaaagtatagatacaaaaccttgtgtaagaggctgacttttccaaataaacattttttaagaaaacatttcttctcccaaatgtctattttcttgaggaaaatattgctgtgtcttcattttcattaccaggtttcattttgggccttgctaaattgattgaattaaatcctccagcttttgaaccttg

SEQ ID NO: 58108 - DNA, 473 bp, Homo sapiens
  misc_feature 5, 12, 41, 44, 83: n = A,T,C or G
gtgcngctcacnaaaccctgagactgacctgcaggacgaanctntgaagagcctgatccttcttgccatcctggccgccttancggtagtaactttgtgttatgaatcacatgaaagcatggaatcttatgaacttaatcccttcattaacaggagaaatgcaaataccttcatatcccctcagcagagatggagagctaaagtccaagagaggatccgagaacgctctaagcctgtccacgagctcaatagggaagcctgtgatgactacagactttgcgaacgctcgccatggtttatggatacaatgctgcctataatcgctacttcaggaagcgccgagggaccaaatgagactgagggaagaaaaaaaatctctttttttctggaggctggcacctgattttgtatccccctgtagcagcattactgaaatacataggcttatatcaatgcttctttcctgtatattc

SEQ ID NO: 58109 - DNA, 431 bp, Homo sapiens
  misc_feature 12, 16: n = A,T,C or G
tgtcgctagtgnatcncagaagaggccaggacaggttaatccactcgcttgggaggcagaaggaaatctttccgtatcacccaggctgatcttcaacgaattggactcaagtattcctcccacctcggcctccaggggggactgtttgacgccagagtggagacggtcaggcagccactcgggccttggaagcaaagtcaaaaaaaacatttcaagttaacttctcaaggaaaatccttctgaaatgtaaaattactgaattcctccttgttgaatgtacagctggtataaaaatggtgctttgcgtcatgaagaaggtgtattctgggatcaaaccacctggctggagatgcttactaacctcagtttcttcatccgaccttacctttctaaaagaataaggaagaagatgatccatattcctctaaagt

SEQ ID NO: 58110 - DNA, 477 bp, Homo sapiens
  misc_feature 13, 19, 41, 44: n = A,T,C or G
cgcgcttcccganactganggggcaggccggagcttgaggnttncgcagataagtttttttctctttgaaagatagagattaatacaactacttaaaaaatatagtcaataggttactaagatattgcttagccgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaaggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatg

SEQ ID NO: 58111 - DNA, 158 bp, Homo sapiens
cgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagttgc

SEQ ID NO: 58112 - DNA, 459 bp, Homo sapiens
  misc_feature 5, 6, 36, 234, 324, 392: n = A,T,C or G
ctacnnagcttgcatagcatgagagccgtatcgttnaacatgtgccactctcgagaagcccttcatatgtggtgatatttcacttttaactcccttccttattttcattcttttaaaagatattttaactgcttagacctttgccagacctgcattcatcattggtagagaaagaactatgtacttttctcctccatcctcttctgatctgcttactgattgagtgcctgttgnaaaacagtaggaaatcacagagcatctgggggaggaggtatcatatcactgctattattctttatcagcgcttggccataaaaattctgnatttggagaaaagtagggtattggtcagcatataattatagtagaaaccccatgtatttttagatggngccatttactgcttaacagagattctactctgatacagaaacgggaattacttgtgcatttgtccag

SEQ ID NO: 58113 - DNA, 115 bp, Homo sapiens
aactctctgtatgacaactctacagaagttgtgcgcgtgctttctcagcagcatttttccttcaaaatcatctttttaatcaacagtcattaataaatgtacatgtacgatattc

SEQ ID NO: 58114 - DNA, 204 bp, Homo sapiens
  misc_feature 7, 16: n = A,T,C or G
ctcacanagctatgtnaccttacaccagtcacttaacttgttagccatccattatcgcatctgcaaaatggggattaagaatagaatcttggggttagtgtggagattagattaaatgtatgtaagacacttggcacaaaacctggcacatagtaaaggctcaataaaaacaagtgcctctcactgggctttgtcaacacgtga

SEQ ID NO: 58115 - DNA, 140 bp, Homo sapiens
  misc_feature 22, 27, 29, 75, 78: n = A,T,C or G
cagccatcacagactaataggntatcncnaaagtccaaaaaaagataggggcacaacccagaaccacaaaatttntgnagaaaaccaatatcatgaaggagagtaccaaactatataaatggaagaactaatgcccaagg

SEQ ID NO: 58116 - DNA, 199 bp, Homo sapiens
  misc_feature 6, 26, 27, 28, 72, 74, 175: n = A,T,C or G
ggcgcntgccaagaatagatgatatnnnccctgatcattgttaatttcaacaatattttcttctcttcttgntnggctgaaacatcctgaggttttccactctctcatgttctaaggtcagacttctgaatcctctcattttaagtctaggtcagtgatcttcaaccttggctgngtactggacccacctgaggagatt

SEQ ID NO: 58117 - DNA, 262 bp, Homo sapiens
  misc_feature 31: n = A,T,C or G
ccggagacaggccctatgtgtgccccttcgntggttgtaataagaagtttgctcagtcaactaacctgaaatctcacatcttaacacatgctaaggccaaaaacaaccagtgaaaagaagagagaagacccttctcgaccacgggaagcatcttccagaagtgtgattgggaataaatatgcctctcctttgtatattatttctaggaagaattttaaaaatgaatcctacacacctaagggacatgttttgataaagtagg

SEQ ID NO: 58118 - DNA, 432 bp, Homo sapiens
  misc_feature 12, 34: n = A,T,C or G
cgcagataagtntttttctctttgaaagataganattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggctacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatg

SEQ ID NO: 58119 - DNA, 273 bp, Homo sapiens
  misc_feature 33, 57, 74, 76: n = A,T,C or G
gcacatgtgggctcacgcctgtaatcccagcangtttgggaggctgaagcaggcagnatcacgaggacaggaanancgagaccatcctgactaacatggtgtgaaaccccgtctctatttaaaaaaatacaaaaatttagtcgggcatggtggcatgcatctagtcccagctactcgggaggctgaggcaggagaatctcttgaactcaggaggcggaggttgcaagtgagccgagatggcactccaacctgggtgacagagcgagactccat

SEQ ID NO: 58120 - DNA, 103 bp, Homo sapiens
  misc_feature 2, 11, 68, 88: n = A,T,C or G
gnaatcactancccatgcctataagggagactgggcaaaaccctggaccaatgaccaccctggaagtngctttttttaaaaaaataanaaatttcctaaatct

SEQ ID NO: 58121 - DNA, 282 bp, Homo sapiens
  misc_feature 12: n = A,T,C or G
ccctctccagangaggagaagaggaaacacaagaagaaacgcctggtgcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggga

SEQ ID NO: 58122 - DNA, 344 bp, Homo sapiens
tatactgtctgcattatagtaggcatttaatagttaataacaagcatccttgtcactgagtggaatgaaacaagcattaaaaactgtttaattttctcagtgtgaggcatttcatttgtaaggcagcaaacaagaagagagaaagaaggagaaacaaattttgtgatttgttttctatgaaagaaaaaggttaaatgtatgttttcatttttttatgtttctacttcatgttttaaaaaattattcattagtttcctttggaaaacttgggtcaaatcattcttctgaatgtccattagaattcctgtgattcagaaaaattttagatcctcaactttattttg

SEQ ID NO: 58123 - DNA, 227 bp, Homo sapiens
  misc_feature 32: n = A,T,C or G
ctattgtagacatgaaatgcgaacacttactngcatattaatgttaactcaaccttagggacctggaatggttgcattaatgctataatcgttggatcgccacatttcccaaaaataataaaaaaatcactaaccttttttaaggaaaatatttaaagttttacaaaattcaatattgcaattatcaatgtaaagtacatttgaatgcttattaaaactttcccaat

SEQ ID NO: 58124 - DNA, 345 bp, Homo sapiens
  misc_feature 28: n = A,T,C or G
aatttcttttattagagttttgtagttntctgcatatatatcctgtacacattttgttaagcttataacaagcatttcattcattttggtgctactgtaaatggtattgtgcttttcaattcaaactccaattttactgctggtatgtatgagagtaatttcctgttatatattaaccttgtatcctataaccttgctataattgattatgtgtttaagaatttttgggggctgggcaccgatggctcatgcctgtaatcccagcgctatgggaggccaaggtgggggatcacccgaggcaggagttcgagaccagcctgaccaacatggagaaacctcgctcta

SEQ ID NO: 58125 - DNA, 206 bp, Homo sapiens
  misc_feature 31: n = A,T,C or G
attaggaagtgctggtggcagtgaagaagcncccaggccacttgactcccagtctggtgccctgtctacaccagacaacacaggagctgggtcagattcccctcagctgcttaacaaagttcctcgaacagaaagtgcttacaaagctgccttctcggatactgaaaggtcgagttttctgaactgcactgattttattgcagttg

SEQ ID NO: 58126 - DNA, 480 bp, Homo sapiens
  misc_feature 3, 48, 49: n = A,T,C or G
aanaggcgcggttgccgagagcagtaagtggtgcagtaaaatactttnnttattcaaagaatgttatctttcttgcaagagtaatttaagcacatgggaaagattctagactttttgtttcttgcaacaacagtgccctctgctgctagaaacctttttctacttactatcatttttattgtggcttgagctcagtcaatctggtgcagatgaggctggacaactactaaccaataaaatcaggagtttgtacaaaagttaaatggaacattataattattttaagtaatgttaattgaaaaatttttttctttttgacaatataaaaaacattttaaatttcctagaaatgtcttcagggtaatgccaatttaagatctctcttaacttgtggccaagaaattctagattttccagctgactttggtataatatatatttatcaggaacttctctcagcagagagtcccattcttcgag

SEQ ID NO: 58127 - DNA, 310 bp, Homo sapiens
  misc_feature 30, 230: n = A,T,C or G
tgtaaacctattttcctatgaaaaaaattntaaatgtcccacttgaataacgtaattcttcatagtttttttaatctatggataaatggaaacctaattatttgtaatgaattatttagacagttctaagccctgcttctgggagttatcaattttaaagagaacttttgtgcaattcaaatgaagtttttataagtaattgaaaatgacaacacaataacactttctgnataaaagtatatattttatgtgatttattcctactaaatgaaagtgcactactgcctcatgtaaagactcttgcacgcag

SEQ ID NO: 58128 - DNA, 376 bp, Homo sapiens
  misc_feature 31, 34, 55, 56, 90, 282, 285, 358, 360: n = A,T,C or G
cgcagataagtttttttctctttgaaagatnganattattacaactacttaaaanntatagtcaataggttactaagatattgcttagcngttaagtttttaacgtaattttaatagcttaagattttaagagaaaatatgaagacttagaagagtagcatgaggaaggaaaagataaaaggtttctaaaacatgacagaagtacgggaaggcgaagaaaagaatagagaagatagggaaattagaagataaaaacatacttttagaagaaaaaagataaanttnaacctgaaaagtaggaagcagaagaaaaaagacaagctaggaaacaaaaagctaagggcaaaatgtcaaactnanaagaaaattggaagat

SEQ ID NO: 58129 - DNA, 426 bp, Homo sapiens
  misc_feature 4, 7, 54, 58, 62, 68, 345, 402: n = A,T,C or G
ctgnaancagagtgtaagagctggcgcaagacagacagcctttacaaggatgcnacgnagtntgcttntgaatctaaagatactgaattggctgaagaactcctgcagtggttttttgcaggaagaaaaaagagagtgcttggagcttgctgtttacctgttacgatcttttaaggccagatgtcgcctagaaactgcatggaggcacaatatcatggattttgccatgccctatttcatccaggtcatgaaggagtacttgcaaaggtggataaattagatgcttcagaatcactgagaaaagaagaagaacaagctccagagacacaacccattggttatggnaatctctctctgtacctcaaaaaattcattagacaaatattaattcttagagactgngcctcaaaatagaataccaccagc

SEQ ID NO: 58130 - DNA, 223 bp, Homo sapiens
  misc_feature 2, 11, 27, 28, 29, 31, 58, 199, 207: n = A,T,C or G
anatactcccncgaaggcgcgctcaannnangaagaaaatagcaaattcacctacacntttctggaggatggttgcaccgaaacacactggggaatggagcaaaacagtctttgaatatcgaacacgcaaggctgtgagactacctattgtaagatattgcccctatgacattggggggcccggacaagaatttggtgnggaccgtngccctgttgctttttt

SEQ ID NO: 58131 - DNA, 224 bp, Homo sapiens
  misc_feature 12, 19, 28, 33, 34, 36, 37, 41, 44, 46, 47, 50, 54, 58, 66,67, 71, 74, 75, 90: n = A,T,C or G
caagaggacgcncttcctngattcatcnggccnnannagtnaanannttngctntcangaagttgnngganggnntctatgtctctgaanaaggaactgttcagcaggctgatgaataagatctaagagttacctggctacagaaagaagatgccagatgacacttaagacctacttgtgatatttaaatgatgcaataaaagacctattgatttggaccttca

SEQ ID NO: 58132 - DNA, 474 bp, Homo sapiens
  misc_feature 16, 18, 32, 33, 36, 43, 48, 108, 109, 116, 156, 158, 193,353, 389: n = A,T,C or G
cggagacgcgctaccnanatcattgaatatanntcngcaattntcttncttatgtatacactttttctgtacttactaggttaaggcagatttatctttatgatttgnntaggaantatttgattttataatgggaattttcatgatgataatgtntntggttatttggaaagatagtttagagatgaaaggntttttgggtaacaatcccgcagctgcaaaaaatgtgaaatttccacaaaatatccaacttatgtgactaaacgcagtagtttttttaaaaggggagatagaaaataaatggttttgttggagtgcattttagtaagcctttgcagtaaaatgacggttgnaactactaaaccaaatttaagttttcacagcatggntttgttgtttccccttgtttttcagaggtaaattttgcattatatccttcagtattttaacactattttggcagtttacacatta

SEQ ID NO: 58133 - DNA, 105 bp, Homo sapiens
caccgagatgcatttttatgcttattttctgtcaacactaatgaagtcaacattgcctgaatgtctgaataatgaaacacatccctgtttaaaagtatgtaactg

SEQ ID NO: 58134 - DNA, 308 bp, Homo sapiens
  misc_feature 8, 26, 30, 38, 42, 48, 51, 54, 55, 72, 100, 102, 111, 146: n = A,T,C or G
tggagatnacttacaactgctttgancagntctcgtcnatangctacnaanatnntgcttagccgctaaagntttaaccgtaattttaatagcttaagantntaagagaanatatgaagacttagaagagtagcatgaggaagganaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagc

SEQ ID NO: 58135 - DNA, 469 bp, Homo sapiens
  misc_feature 11, 17, 43, 53: n = A,T,C or G
agtcgcgcttnccgagncatcgccggcctcgctatgtctgccnttttcaattntcagagtctattgactgtaatcttgctgcttatatgtacctgtgcttatattcgatccttggcacccagcctcctggacagaaataaaactggattgttgggtatattttggaagtgtgccagaattggtgaacggaagagtccttatgttgcagtatgctgtatagtaatggccttcagcatcctcttcatacagtagctggggaaaatgccagaatgtagttgccatcagatttgattgtgaacaaggctgactgcagaaaataatggaaaggatgtttaactcttttatctccgaacattgaatgagataaatttccagatgctgtctctattttaatggtattgaccaatgtctgtataaacaattaagatgtaaccatttaatagtctgaacaatcaacctcagtctgcat

SEQ ID NO: 58136 - DNA, 255 bp, Homo sapiens
  misc_feature 9, 23, 27, 32, 33, 35, 39, 41, 46, 48, 51, 54, 57, 59, 62,64, 67, 68, 73, 75, 77, 78, 79, 97, 104, 145, 160, 178,201, 202, 219: n = A,T,C or G
aaactaatnatagacgggttatnatgnaaaanncntgantnggctncnganatncancnacnanccnnctganantnnnccgcccgtggagccaaanactgacntggcaacagccgatggactcaactcgagccttcaaacttgnaggatcctattatancgtaaactaatacattgnctagcattgatttggtcccggcnnatgtattttcactatgngctcccctccccagatcttaattaaaccagagttgc

SEQ ID NO: 58137 - DNA, 256 bp, Homo sapiens
  misc_feature 30: n = A,T,C or G
caagctaattttctttttctgaagcctctnacaaatgatctagttcagaaggaagcaaaatcccttaatctatgtgcaccgttgggaccaatgccttaattaaagaatttaaaaaagttgtaatagagaatatttttggcattcctctaatgttgtgtgttttttttttgtgtgctggagggaggggatttaattttaattttaaaatgtttaggaaatttatacaaagaaactttttaataaagtatattgaaag

SEQ ID NO: 58138 - DNA, 131 bp, Homo sapiens
  misc_feature 31, 33, 40, 53: n = A,T,C or G
tggtagctgaccctcgtcgctgcgagtccananagtttgnaggccctggtgcncgcgctcgctaccagaaatcctaccgataagcccatcgtgactcaaaactcacttgtataataaacagtttttgaggg

SEQ ID NO: 58139 - DNA, 109 bp, Homo sapiens
  misc_feature 6, 14, 27, 36, 37, 39, 54, 57: n = A,T,C or G
cataangagaggcncaaatggacacantaacaacannanccttaaaggtgaaangantagaggccccacttaaaagacacagactggcaaattggatagagtgacaaga

SEQ ID NO: 58140 - DNA, 333 bp, Homo sapiens
  misc_feature 18, 257, 279: n = A,T,C or G
cagcgaaagtcacccaancacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggngggtgattattttttatactgnatgtgccaaagctttactactgtggaaagacactgtttaataaaagattacatt

SEQ ID NO: 58141 - DNA, 220 bp, Homo sapiens
  misc_feature 36, 219: n = A,T,C or G
ctgaggggcaggagtgcttcctggtgtgtgtattanaatcccttcctgccttgtttcatggcagtgaaatgcctcttggtcctgtccaagtgtatctttcactgatttctgaatcatgttctagttgcttgaccctgccacatgggtccagtgttcatctgagcataactgtactaaatcctttttccatatcaagtataataaaggagtgatgtgcant

SEQ ID NO: 58142 - DNA, 484 bp, Homo sapiens
  misc_feature 10, 26, 31, 44, 52, 54, 108: n = A,T,C or G
taatttcccngtggcggctcgccaanaatcntgagaaaagcctntagattantntgtaagaaaagaaaatagaagccatgtttcgaagacctgtattacaggtacttngtcagtttgtaagacatgagtccgaaacaactaccagtttggttcttgaaagatccctgaatcgtgtgcacttacttgggcgagtgggtcaggaccctgtcttgagacaggtggaaggaaaaaatccagtcacaatattttctctagcaactaatgagatgtggcgatcaggggatagtgaagtttaccaactgggtgatgtcagtcaaaagacaacatggcacagaatatcagtattccggccaggcctcagagacgtgggcatatcaatatgtgaaaaaggggctcgaatttatttggaaagggaaaatagactatggtgaatacatggataaaaataatgtgaggcgcaagcaacaacaatcatagctgatat

SEQ ID NO: 58143 - DNA, 388 bp, Homo sapiens
  misc_feature 7, 14, 41, 42, 43, 286: n = A,T,C or G
cagtttnggcaaantgagcgggtcacaaactcttatagagnnntggaagtgtgaatctttgaagcctgaatgttcagcaaaactgccttgaaaataaaaaggctgcgatttgcagccacctctctgggccctggtgataagagtgccttcatgggaagtgataactcgccctgataccgtgtgagccagcactattgaacagtgtgctcatccatgcagagttggaatacacatctgtgcctcattgatatgccactgcttaaaaaaaaagtaagatctttactgntctactgattcattggggaaaaaaaagatttggccagctaaagccatgtactgcatgaaacagagcactgtgcataggggacggctccatggactagatcac

SEQ ID NO: 58144 - DNA, 197 bp, Homo sapiens
  misc_feature 6, 155, 167, 189: n = A,T,C or G
taggantaagctctagttcttaacaaccgacactcctacaagatttagaaaaaagtttacaacataatctagtttacagaaaaatcttgtgctagaatactttttaaaaggtattttgaataccattaaaactgcttttttttttccagcaagtntccaaccaactnggttctgcttcaataaatcttnggaaaaac

SEQ ID NO: 58145 - DNA, 470 bp, Homo sapiens
  misc_feature 2, 15, 45, 76, 441: n = A,T,C or G
gncgcgcttaccganagggattgtagttgggagttaccatgtttntcaaacataattaacatgtaattagtttacngattgtagggcatcacttcaattcaccaagcatgtagttctagcgcactagcatggcgccagccatgtacttacaatgtagttacagagtaattacatggtgatttttgcaatgtaaaataaagtgtttctgattattttctatgtaaaggaaccctctcctttccccttctggtccctgcgctttggtataatatatatacttctccatacacagacctctgcagaatgcaaaataaaacttgcagtgaatgaatttagcattttatgagagtgctgttggaaagacttgataattcaccccttttgttttgaagagtgaatcttctgtaaaaggtgattaaaacttgaatgtgatgaattggnggcaaggtaacttcaagttatgtgcaata

SEQ ID NO: 58146 - DNA, 434 bp, Homo sapiens
  misc_feature 421: n = A,T,C or G
cctagtcaccatggcctggggccagtatggcggattatggatacccataccagcagtatcatgactacagcgatgatgggtgggtgaatttgaaccggcaaggcttcagctaccagtgtccccaggggcaggtgatagtggccgtgaggagcatcttcagcaagaaggaaggttctgacagacaatggaactacgcctgcatgcccacgccacagagcctcggggaacccacggagtgctggtgggaggagatcaacagggctggcatggaatggtaccagacgtgctccaacaatgggctggtggcaggattccagagccgctacttcgagtcaagtgctggatcgggaagtggcaagttttactgttgtccgctacagcaagaagtgcccatattcctgctggctaacaacagaatatncaggtcactatgg

SEQ ID NO: 58147 - DNA, 437 bp, Homo sapiens
  misc_feature 9, 10, 40, 419: n = A,T,C or G
cgccgtcgnntattgaagctctgtttggtgctttggatcnttttccatcggtccttacagccgctcgtcagactccagcagccaagatggtgaagcagatcgagagcaagactgcttttcaggaagccttggacgctgcaggtgataaacttgtagtagttgacttctcagccacgtggtgtgggccttgcaaaatgatcaagcctttctttcattccctctctgaaaagtattccaacgtgatattccttgaagtagatgtggatgactgtcaggatgttgcttcagagtgtgaagtcaaatgcatgccaacattccagttttttaagaagggacaaaaggtgggtgaattttctggagccaataagggaaagcttgaagccccattaatgaattaagtctaatcatgtttccgccantataacccccattggcta

SEQ ID NO: 58148 - DNA, 358 bp, Homo sapiens
  misc_feature 6, 81: n = A,T,C or G
cggagncgcgctatccgagatacttgaagaatgttgatggtgctattttgaatttgagaagaaatactcctgtattgagtngtatcgtgtggtgtattttttaaaaaatttgatttagcattcatattttccatcttattcccaattaaaagtatgcagattatttgcccaaagttgtcctcttcttcagattcagcatttgttctttgccagtctcattttcatcttcttccatggttccacagaagctttgtttcttgggcaagcagaaaaattaaattgtacctattttgtatatgtgagatgtttaaataaattgtgaaaaaaatgaaataaagcatgtttggttttccaaaag

SEQ ID NO: 58149 - DNA, 243 bp, Homo sapiens
atcatttaacatatagtaggatagtttaagtgtagggaggacaattattgtctgaagctaaaatgggttatttataggactgatggaaatgatttcatctctgccatctctaaagcacttttcattgaacatgttagcctaggataccgtacagtaaattaacaatgatagcagcagatgcctagctcatcctgggtttgcttctgaccttgcatgtgtgtgccaccaaacacgttattggca

SEQ ID NO: 58150 - DNA, 216 bp, Homo sapiens
  misc_feature 3, 14, 36, 41, 52, 86: n = A,T,C or G
aanctctcatcctnctgccaggctcccctgcctgtnggttnggcattgtcanataatgtgatcattcattgaagtgacatttgagntccaaaccagttttctcctttaaccatttcaccctcaggagtgattctcctttgtttggcattgtcagggaatgtgatgatccattcaaatgacttttgagttccaaataagtgtttctactttaacttc

SEQ ID NO: 58151 - DNA, 485 bp, Homo sapiens
  misc_feature 2, 14, 48, 50, 406, 450, 466: n = A,T,C or G
cntgggcgcggctntcctagatgagggggcaaggcggagcttgaggantncgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttaagtttaaaagttgnaggtgattaaaataatttgaaggcgatcttttaaaaagagattnaacccgaaggggattnaaggccttgaaatccatga

SEQ ID NO: 58152 - DNA, 224 bp, Homo sapiens
  misc_feature 29: n = A,T,C or G
cttattaaatgaattaaaattggaatctnggagtgttttaagtttcatattttaaaaattttagacctagtgggtagaatagagatcatccaatccaataatgtcatgttacagataaggaaactgacatgtgattatactcatggagtgagtaaaggcagagctgaaattgggcttgtcagacccccagactccagcctggtgacagagtgagtctctgtctt

SEQ ID NO: 58153 - DNA, 370 bp, Homo sapiens
  misc_feature 48, 66, 69, 90, 154: n = A,T,C or G
gatgatcacggacgtgcagctcgccatgttcgccaacatgctgggcgngtcgctcttcttgcttgncgntctctatcactacgtggccgncaacaatcccaagaagcaggaatgaaagtggcgctttctccgccccagggttccaggacatagnctgaggcaagatggagggtatgaggggccttcacacttcacttcatcccttctacccatcacaacatacaaagcaactacacctggatttttccaaacaacttttatttcctcagagtcttccttaatcctatggaacaagaagctgcactgaatagggcccagtataggggcttgcttttctactccctcccccaatataaaaatatagactttg

SEQ ID NO: 58154 - DNA, 356 bp, Homo sapiens
ctggatttttatgttttattagcattttcaagaagacggattatctagagaataatcatatatatgcatacgtaaaaatggaccacagtgacttatttgtagttgttagttgccctgctacctagtttgttagtgcatttgagcacacattttaattttcctctaattaaaatgtgcagtattttcagtgtcaaatatatttaactatttagagaatgatttccacctttatgttttaatatcctaggcatctgctgtaataatattttagaaaatgtttggaatttaagaaataacttgtgttactaatttgtataacccatatctgtgcaatggaatataaatatcacaaagtg

SEQ ID NO: 58155 - DNA, 267 bp, Homo sapiens
ccccgaccagcagaggctcatctttgcaggcaagcagctggaagatggccgcactctttctgactacaacatccagaaagagtcgaccctgcacctggtcctgcgcctgaggggtggctgttaattcttcagtcatggcattcgcagtgcccagtgatggcattactctgcactatagccatttgtcccaacttaagtttagaaattacaagtttcggtaatagctgaacctgttcaaaatgttaataaaggtttccgttgcatggt

SEQ ID NO: 58156 - DNA, 117 bp, Homo sapiens
  misc_feature 31: n = A,T,C or G
atataaacttggtttactgtaatagtgtgcngttcatggaaaccgagggctgcatcttgtttatagtcatctttgtactgtaatttgatgtacacaacattaaaagtactgacacct

SEQ ID NO: 58157 - DNA, 429 bp, Homo sapiens
  misc_feature 10, 20, 340, 408: n = A,T,C or G
tccataactnataaatttgnaatgtgttcctccttgttggagacattagccagtgtttagttttagaccaacttatacaaacagagtattgatttgtacacattctggagacttgctatatcatggtttgctatggcacagactcagcttagcatggggacattttgaacttcattcaaagttgagtagttactggaacctttgacattgccttgtaatgaggtacttccaaaaaaagacccctaacaatggcataatagtgaggctctctgtgcatatacataatatatatgcaggataaatgtgtgcaccaatcaaatctaaaattttatgtgactgncaaatgaatattatttggggtaagatttttcatttctgatttggatagaaaattgctattaatcttgnattaaaatagtttttaaacat

SEQ ID NO: 58158 - DNA, 307 bp, Homo sapiens
cagtaaattccgggaaattcaacaggagctttccagtggaaggaatgaaggccagctgaatggtgaaacaaatacacccattgaaggaaaccaggcgggtgatgcagctgcctctgccaggagtctaccaaatgaagaaatagtgcagaagatagaggaagtactttctggggtcttagatacagaactacgatataagccagacttgaaagagggctccagaaaaagtagatgcgtatctgtacaaacagatcctactgatgaaattcccactaaaaagtcaaagaagcataaaaagcacaaaatc

SEQ ID NO: 58159 - DNA, 443 bp, Homo sapiens
  misc_feature 18, 19, 27, 28, 40, 42, 73, 390: n = A,T,C or G
cggcttacctagaacgtnngagaacannggcaagaaggantntctcggggccatttgctcctgcacatgcttnggaggccggcggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttaaaagttcttctttctttcttaagccctttgctctgggangaagttctccagcttcagctcaactcacagcttcttcaagcataccctgggag

SEQ ID NO: 58160 - DNA, 404 bp, Homo sapiens
  misc_feature 12, 13, 28, 47, 50: n = A,T,C or G
atgtgctcgctnngcaacaaactctatnaagcggagttgcaagcgcnttngtggcccgccgagcagcagaaggcgcagtttactgcacaggtgcatcacttcatggagttatgttgggataaatgtgtggagaagccagggaatcgcctagactctcgcactgaaaattgtctctccagctgtgtagaccgcttcattgacaccactcttgccatcaccagtcggtttgcccagattgtacagaaaggagggcagtaggccatcccccaggagaatgacagaagcaaaggacttgttactaagcagatttaagggtcagtgggggaaggctatcaacccattgtcagatcagcatcaggctgttatcaagtctgttggtgctaaaaagtaaaagatgaaatgtt

SEQ ID NO: 58161 - DNA, 102 bp, Homo sapiens
  misc_feature 11, 13, 42, 49, 57, 79: n = A,T,C or G
aagaactaganangcaagagcggacacattcaagagctagcngaaggcnagaaatanctaaaatcagagcagaactganggaaatagagacacaaaaaacgc

SEQ ID NO: 58162 - DNA, 467 bp, Homo sapiens
  misc_feature 5, 42, 45, 408: n = A,T,C or G
gtcgngctgccgaatagtctacaactatctgatctttgacanttntgagaaaaacaagcaatggggaaaggatttcttatttaataaatggtgctgggaaaactggctagccatatgtacaaagctgaaactggatcccttccttacaccttatacaaaaattaattcaagatggattaaagacttacatgttagacctaaaaccataaaaaccctagaagaaaacctaggtgttaccattcaggacataggcatgggcaaggacttcatgtctaaaacaccaaaagcaatggaaaccaaagccaaaattgacaaatgggatctcattaaactaaagatcttctgcacagcaagagaaactaccatcagagtgaacaggccacctacaaaatgggagaaaatttttgnccctactcatctgacaaaaggctaatatccagaatctacaatgactcaaacaaatttac

SEQ ID NO: 58163 - DNA, 217 bp, Homo sapiens
gcagcatggctgaccaactgactgaagagcagattgcagaattcaaagaagctttttcactatttgacaaagatggtgatggaactataacaacaaaggaattgggaactgtaatgagatctcttgggcagaatcccacagaagcagagttacaggacatgattaatgaagtagatgctgatggtaatggcacaattgacttccctgaatttctgac

SEQ ID NO: 58164 - DNA, 346 bp, Homo sapiens
  misc_feature 5, 40, 61, 72, 79, 98, 291, 324: n = A,T,C or G
cgcgnttaccgagacatgcttttttagtatatttcacaantttacttttaaatattttttntaattatagtnggaaatnatgaaagatccttgaattntctacagatctacaactactaatgtaacagacaagggcaatcttggtatttaaatctgagcatggcagttctaccataaaaagtactctatttttctaatttctaggatttttaaaataacatttctgtaagtctgcatactaatagtcactcaagcagtccatttattttagtttgcatatattttcactgnttttaatttaatgtattgagtctaatagactgntttgcaataattagaataaaga

SEQ ID NO: 58165 - DNA, 458 bp, Homo sapiens
  misc_feature 6, 9, 179, 235, 267, 278, 287, 323, 356, 428: n = A,T,C or G
gcctgnccnagatccatcacaaaacgggtagaaacacatttactgcttcagggttctaatctgtgtgtctccttatgactccatttctgtaagctactctgtaactttgatatatgctgtattttctttctttaaaagatttagatgttttttcagcaagctagccatacaaccattgnatctctttctcttcagtatggtttagagcccagatcagttagtaggctttcgttgncttctctttcaatacatgtacatctttactgnttgaaaagtgntacagctgncaaagaatcttcatggacctgaagataatttcttgngaaggtgaatgcaagtgactgcattcatagtgnttatatcaaaatccaggaatcttcacttttgctaccctgatatagcattgggctatcatggtacaacattgnaatacattgatttattaaaaaatcctttac

SEQ ID NO: 58166 - DNA, 281 bp, Homo sapiens
  misc_feature 10, 22, 44, 58: n = A,T,C or G
ggtgatgatnattaaaacccanagttccttggtcccagcttttncagattttgttcgntctgtgcacccttacgaagtggccgaggtaattgcattgcctgtggaacaggggaactttccgtacctgcagtgggtgcgccaggtcacagagtcagtttctgactctatcacagtcctgccatgatgagccctgttcctgctcatcatgaagatccccgcgatacttcaacgccttctgacttcaggtgatgactgggcccccaataaatcccgtctttggg

SEQ ID NO: 58167 - DNA, 464 bp, Homo sapiens
  misc_feature 8, 11: n = A,T,C or G
cgcgctcnccnagacgggatttcaatgaaaggaggaagagtttgctgataaacctaccagcacctattgagcaatgtctattatagtaattttgcatacatttttatttaagggaaaaaatataggtattgtgaaatattttgctaatcttatagaaaaggaaaaaatcccgttatttaaagggaaaagtaaatttaacagttgccttttttcttaatgtcagggcagatcttattttacagtacagtgggggaaatagaaacatgtgaaaggcaaaaggcaggctcctaaattaatgtcagtgaagttcagggtgggcaaatgagtgtgtgtgaggtataggaaatgctgatgacttctttaatgcttgaagccgtccaggtatctagccctagaatgcctagaacaggaagagcactggtgtctgcaaaacttgacaggggcaaagttgctgaaaaagtttt

SEQ ID NO: 58168 - DNA, 267 bp, Homo sapiens
  misc_feature 11, 17, 27, 36, 40, 41, 60, 63, 67, 69, 77, 78, 79, 83, 87,89, 90, 94, 99, 110, 122: n = A,T,C or G
agtcgctctgnccctanagaggaaacnagcatcaanctannacaaatttaccaactagcntcntaangngaggctcnnnttgncacntnncaanattanccttaaatgtnaaaggactagangccccacttaaaagacacagactggcaaattggatagagtgtcaagaaccatcagtgtgctgtattcaggagactctcatgtgtaaaaacacgcataggctcaaaataaagggtaggaggaatatttactaagcaaatggacagc

SEQ ID NO: 58169 - DNA, 282 bp, Homo sapiens
  misc_feature 5, 6, 281: n = A,T,C or G
ccccnncctagcaagggcagcctgcggaggaaatatttgagagtgtaggagatcgagagctaagacaagtctttgaaggacagaatcgtattcatcttgaaatcaagcagctgaaccggcagttagatatgattcttgatgaacagagaagatatgtctcttccttaacagaggaaatctctaaaagaggagcaggaatgcctgggcagcatgggcagattactcaacaagaactggatactgttgtgaaaactcagcatgagattctgagacaagcctcnc

SEQ ID NO: 58170 - DNA, 427 bp, Homo sapiens
  misc_feature 31: n = A,T,C or G
gcaccttctatgaaagtagatgaatgtggtnctatccccacccctatttctttattctttttaatgagataacgggtagaaacattagaaaatgtgcttagacaaaaactttgaacttaaaatccttgttctttcttccctgctatttgaagagaagctatttctgccaacactaaaatagtgctctggatttaggcatttctgctacataacccactaaactaaaattcttcatccagagacctgacgtttaaagtagattccagcttagtggaagtgagattatatgtcagatgattgatgtggtgtggcagttggggatttccatttagaaacaagctgccactttcgttgctgtggggcttcattgtggagtctcattcctaaatttgaattgtttttaagcagaataatggaaagattaagc

SEQ ID NO: 58171 - DNA, 470 bp, Homo sapiens
  misc_feature 11, 16, 44, 48, 453: n = A,T,C or G
tgtcgcgcttnccaanaagactttgcagataactaaatagactntttnaaatatgttgcatttgatagaagcaattgcataaatatttggtttctatattagagtctgtgagtaaagtcaagtaataaacctaagtaggtataacagatttttaaaccttgaaacttgctttgatggtagagaaaatcattgaagatttacatactgtatataagatgtaaaatgtacgctgcttattaccctcaattttccagaagcaatggtatataatgcagttgaaaaaccaaaaatcttggaaaactaagacgggtcttgtttaaaatgtctctcagctttggcaaccttcaaatcttaatcaactatttaaagcattactgtgcttgtagcctgcattccacaacagctctgttattcaggtaaaagacttgaactgagccgttgggacctatctgnaatatttcattgaggac

SEQ ID NO: 58172 - DNA, 405 bp, Homo sapiens
  misc_feature 179, 198, 200, 297, 350, 366, 393: n = A,T,C or G
ctttgttctatgaaaatcactgcagatgacttatggatcagaacttatgccagactttatcagaagttgtgttcttctactggagatgttcccattggaatctacaggactgagtctcagaaacttactacatctgagtctcgaaaaatagcatcacaagtaaagtattttctggttgnttccctttcctcaaatggngnaatatattaattcagagctattaaagaaaaataatattaaatattgaatttaatacccagacattaaaatgaaataaatcatttaaacctaaatgcntataaatggtttcttttcaaattaatggcctatatttccccagtaaaattccnggaatttgccatttgnaaagaataaattctaagaaggatttgnttcgatattttg

SEQ ID NO: 58173 - DNA, 265 bp, Homo sapiens
  misc_feature 2: n = A,T,C or G
gncggcgcttaccgagaactaacataatacaatatttacatctttaaagtttcattatgcttaatactaaaagcatccctactaaacacaaagatagactgagtatccattatcaccattaccatttaacagtactgaatgtgcctgaataaataatttgacattaaaaaaagaaatcagaggtttcaaaaatataaaaagaggagcaaaaactatccatttgcagaaaatacaattgtatgcttacaaacctattaaattgggg

SEQ ID NO: 58174 - DNA, 427 bp, Homo sapiens
  misc_feature 31: n = A,T,C or G
atgttagttttttctgatccataagaagcanatttatacctatttgtgtattaagcacaagataaagaacagctgttaatattttttaaaaatctattttaaaatgtgattttctataactgaagaaaatatcttgctaattttacctaatgtttcatccttaatctcaggacaacttactgcagggccaaaaaagggactgcccagctagaactgtgagagtatacataggcattactttattatgttttcacttgccatccttgacataagagaactataaattttgtttaagcaatttataaatctaaaacctgaagatgtttttaaaacaatattaacagctgttaggttaaaaaaatagctggacatttgttttcagtcattatacattgctttggccaatcagtaattttttcttaagtgt

SEQ ID NO: 58175 - DNA, 429 bp, Homo sapiens
  misc_feature 32: n = A,T,C or G
aagtcttttttaactcatgatttttacacacncaatccagaacttattatatagcctctaagtctttattcttcacagtagataatgaaagagtcctccagtgtcttggcaaaatgttctagtatagctggatacatacagtggagttctataaactcatacctcagtggacttaaccaaaattgtgttagtctcaattcctaccacactgagggagcctcccaaataactattttcttatctgcagtattcctccagaagagctaaccagggcagggctggcatgagaagtgacatctgcgttacaaagtctatcttcctcataagtctgtaaagagcaattgaatcttctagctttagcaaacctaagccaaaggaaggaaagcccgaagaatgcagaagtcaaaccctcatgacaaagtaggcaca

SEQ ID NO: 58176 - DNA, 428 bp, Homo sapiens
  misc_feature 393: n = A,T,C or G
gtctgccatagcaatcagcagaacgcctgttctcatgaacttcatgatgagaggctcttgggtgacaattggtgtgacctttgcagccatggttggagctggaatgctggtacgatcaataccatatgaccagagcccaggcccaaagcatcttgcttggttgctacattctggtgtgatgggtgcaagtggtggctcctctgacaatattagggggtcctcttctcatcagagctgcatggtacacaagctggcattgtgggaggcctctccactgtggccatgtgtgcgcccagtgaaaaagtttctgaacatgggtgcacccctgggagtgggcctgggtctcggctttgtgtcctcattgggatctatgtttcttccacctaccaccgnggctggtgccactctttactcagtggcaatggacg

SEQ ID NO: 58177 - DNA, 112 bp, Homo sapiens
  misc_feature 20, 41: n = A,T,C or G
gtcgcgccacccaataactnacgacatgcggcttttctgcntttactgctatgacggttaagaatgtcagtatacaagaaggaatagaaaactgatactgttttaaataatc

SEQ ID NO: 58178 - DNA, 467 bp, Homo sapiens
  misc_feature 6, 9, 54, 77, 440, 451, 455: n = A,T,C or G
cgcgcnacngtatataagccaattattaaaaaatacaccttttatcattgatgngagtgcctgtggaaataactganaaagagacacgagaagaacgaatcattacaggtcctgaaataaaatacactaggatttctactggaggtggagaaacagaagaaactctgaagaaattgttacaagaagacacacccgtgaggaagttgcaagccaacaaaaaagttcaaggatctagaagacgattaaggggaaggtcgtctcagtgaaaatccaaaaaccagaaaaaaatgtttatacaccctaagtcaataacctgccttagaaaattgtgagagccaagttgacttcaggacctgaacatcagcccaagaagccatcatcaaataattctgacccaaattaatatttttttttctgatgaaaaccatgagggaaattgnggagtagcccnctgnggtaaaggaatg

SEQ ID NO: 58179 - DNA, 164 bp, Homo sapiens
  misc_feature 3, 11, 30, 36, 38, 51, 146: n = A,T,C or G
gcnacatcgtntaaactggcactggaggcngtccancntactccaaagatncaggtttactcacgtcatccagcagagaatggaaagtcaaatttcctgaattgctatgtgtctgggtttcatccatccgacattgaagttgactnactgaagaatggagagag

SEQ ID NO: 58180 - DNA, 461 bp, Homo sapiens
  misc_feature 2, 8, 73, 221, 223, 245, 257, 319, 328, 336, 354, 388, 423,426, 432: n = A,T,C or G
gncgcgcncccgagatgagtaatatagggtatgaatggttttatcaaggctttattttggaagtaagaaaaanggcagtgatgattaaattgctgcagtccataatttgggcttgttatttgtacattaaagattttttccaagtaagttacactctgttaacttcctgctagccatcagcatgagccctactgcctaaacactatttcatttatttatgntnggaaaccccgtaacatttttgnttgcaatcttgnttcttttgttataagtcaagtgttgaatgttacaatacttttattgaaacttttgttaagtnttttcttgnaaatttcnttacttgtgagatcatcntgtcctttaatcctgtaccctaaaataagaaatncatttttgacagaggcttaatggtttacaaaagangtnggacanttttattttaaaaatttaggcaaaagtca

SEQ ID NO: 58181 - DNA, 472 bp, Homo sapiens
  misc_feature 3, 8, 30, 49, 68, 426, 463: n = A,T,C or G
ganggggngcgtgcccgagatgagccctancgtacggcctttcactttntcttcaagccttcaggctntcttctagtcaagatgagtgataaaccagacttgtcggaagtggagaagtttgactggtcaaaactgaagaaaactaatactgaagaaaaaaatactcttccctcaaaggaaactatccagcaggagaaagagtgtgttcaaacatcataaaatggggatctcctccaaagagcagatttcagcattgcctgacagtcttggttttaggcttgtttttttgtaaacctgtgtgtttgtagagattcagacatcttctgatttcttctcacctatattccctggttaagaggtcaggggtagtgaatgtttccttaagtcctttttaaacttcccattggtatgtaaattccaaatggnaagatgctgtcaataaccttgcatggatgacctttgngtaaggtag

SEQ ID NO: 58182 - DNA, 157 bp, Homo sapiens
cctcgggctaatttccccatagccgtggggtgacttccctggtcaccaaggcagtgcatgcatgttggggtttcctttaccttttctataaagttgtaccaaaacatccacttaagttctttgatttgtaccattccttcaaataaagaaatttggt

SEQ ID NO: 58183 - DNA, 272 bp, Homo sapiens
  misc_feature 5: n = A,T,C or G
taccnattactgatgcttacttcaagaagaagattctgcggaagcccagacaccaggaaggtgagatcttcgacacagaaaaagagaaatatgagattacggagcagcgcaagattgatcagaaagctgtggactcacaaattttaccaaaaatcaaagctattcctcagctccagggctacctgcgatctgtgtttgctctgacgaatggaatttatcctcacaaattggtgttctaaatgtcttaagaacctaattaaatagctgactac

SEQ ID NO: 58184 - DNA, 342 bp, Homo sapiens
  misc_feature 5: n = A,T,C or G
ccatnttcatatataccagcccagtgaacccagctgtcttcccccatctgaccgtggtgcttttggccattggcatgttcttcaccgcctggttcttcgtttacgaggtcacctctaccaagtacactcgtgatatctataaagagctcctcatctccttagtggcctcactcttcatgggctttggagtcctcttcctgctgctctgggttggcatctacgtgtgagcacccaagggtaacaaccagatggcttcactgaaacctgcttttgtaaattacttttttttactgttgctggaagtgcccacctgctgctcataataaatgcagatgtatagct

SEQ ID NO: 58185 - DNA, 478 bp, Homo sapiens
  misc_feature 7, 8, 35, 47: n = A,T,C or G
gcagtgnncgcgctgggccaagagctgagggggcnggcggagcttgntttaacccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttg

SEQ ID NO: 58186 - DNA, 220 bp, Homo sapiens
  misc_feature 1, 4: n = A,T,C or G
ncanatgatgctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacatt

SEQ ID NO: 58187 - DNA, 100 bp, Homo sapiens
  misc_feature 13, 24, 27, 66: n = A,T,C or G
tgaaattatgaangtcaaatctangcngaaggaattcagcaactactcctaatcaatactgggagngctggtagcacgaccaaagactggttcaagatac

SEQ ID NO: 58188 - DNA, 299 bp, Homo sapiens
  misc_feature 5: n = A,T,C or G
tatanatcccaaagagagaaatttgaaaaaactttctctttgccatttcttcttcttcttttttaactgaaagctgaatccttccatttcttctgcacatctacttgcttaaattgtgggcaaaagagaaaaagaaggattgatcagagcattgtgcaatacagtttcattaactccttccctcgctcccccaaaaatttgaatttttttttcaacactcttacacctgttatggaaaatgtcaacctttgtaagaaaaccaaaataaaaattgaaaaataaaaaccataaacattcga

SEQ ID NO: 58189 - DNA, 284 bp, Homo sapiens
  misc_feature 7, 19, 30, 32, 48, 100: n = A,T,C or G
atccctntccagaagacgngactacgaaananaagatgatacgcctgntgcagagccccaattcctacttcatggatgtgaaatgcccaggatgctatanaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttggat

SEQ ID NO: 58190 - DNA, 183 bp, Homo sapiens
  misc_feature 27: n = A,T,C or G
aactgcagttcaacttctatcaccgtngggtttgatgtgatcttcctggtcagcgctctctctagcatactcttcctctatttggctcacaaacaggcaccagagaagcaaatggcaccttgaacttaagcctactacagactgttagaggtcaagtggtttcaaaatttagatataagaggg

SEQ ID NO: 58191 - DNA, 298 bp, Homo sapiens
gagaggtaaatacataaaaactgtatgtgggccaggcgcagtggctcacacctgtaatccagcactttgggaggccaaggcgggcggatcatgaggtcaggagttccagaccagcctggacaacagagtaaaaccctgtctctactaaaaatacaaaaattagctgggcatggtggcacgcgcctgtagtgccagctactcggaggcaggagaatagcttgaacctgggaggcagaggttgcagtgagctgagatcgtgccaccgcactccagcctgggtgacatagtgagactccgt

SEQ ID NO: 58192 - DNA, 326 bp, Homo sapiens
  misc_feature 7, 12, 32, 36, 39, 50, 51, 52, 53, 54, 94, 121, 274, 275,276: n = A,T,C or G
aacaacngaaanttaagttttattgccaaagnaganaantgagaaagtcnnnnncccaaatgcttctttaactgtaacagcaaaactaaatgcntattttatcaaccccttatttctaatngctgtattcatttccacccttaaactatttaagcatttcatctgctgaaagtccttatatacatggtagacggaatatttctccattaatgatagatcaaaatgaagatatttaaaaattaacaaaatcaggccaaggcaggaggatcacttnnncccaggaggtccagaccagcctgggcaacacagcgggccccgctccattt

SEQ ID NO: 58193 - DNA, 471 bp, Homo sapiens
  misc_feature 9, 17, 42, 45, 46, 47, 68, 73, 77, 90, 109, 110: n = A,T,C or G
aacgaccangagggcgntcgactgctatagccgagcgaagcnatnnntaaatcaaaggaacttgtttnttcangctnttctggcagtgantctgacagtgaggttgacnnaaagttaaagaggaaaaagcaagttgctccagaaaaacctgtaaagaaacaaaagacaggtgagacttcgagagccctgtcatcttctaaacagagcagcagcagcagagatgataacatgtttcagattgggaaaatgaggtcgttagtgttcgcgattttaaaggcaaagtgctaattgatattagagaatattggatggatcctgaaggtgaaatgaaaccaggaagaaaaggtatttctttaaatccagaacaatggagccagctgaaggacagatttctgacattgatgatgcagtaagaaaactgtaaaattcgagccatataaataaaacctgtactggtctagttgtttaatc

SEQ ID NO: 58194 - DNA, 484 bp, Homo sapiens
  misc_feature 2, 26, 57, 405: n = A,T,C or G
gntaataatccccctggccgctttgnccaaagtggaatggaaaaatgctcaatatcntcccatccttgctcccttcttttaagggttcaaatgcccatgagcaagccctggaaaccggagtcacagttactgggtgcactgtacactttgtagctgaagatgtggatgctggacagattattttgcaagaagctgttcccgtgaagaggggtgatactgtcgcaactctttctgaaagagtaaaattagcagaacataaaatatttcctgcagcccttcagctggtggccagtggaactgtacagcttggagaaaatggcaagatctgttgggttaaagaggaatgaagccttttaattcagaaatggggccagtttagaaagaattatttgctggttgcatggngggtttttatcatggcttgggccaaaagaaaaactgctaaaagacaaaaaagacctcacccttacttcatctatttttt

SEQ ID NO: 58195 - DNA, 116 bp, Homo sapiens
  misc_feature 5, 16, 62, 73, 99, 102: n = A,T,C or G
acggntggcccggganctagaagacgactaagggaagcgggctctcagagacaatccagccnccaaaaagganggtgtatacaaccctaaggccctccnggnacttggcaaattgt

SEQ ID NO: 58196 - DNA, 421 bp, Homo sapiens
  misc_feature 3, 4, 402: n = A,T,C or G
tanngaggggattaggcacgtgacagtatagcacccatttgaatttaaataaaagtgaaccatatttatctggttatataaaactaaaaatgggggtgtttatataaaactaaaaactaagaatgatgtaaccttttgtctgtgttatctgaacactctacttcctttgcagccttagtcacacaactgagtcatctcaagtactctttaaggacacacagcccaggctgtctgagtcagaataggcccctacaggtatattttaaaactcttcgtaattctaatgtgtactgctggtatagctgaactactgcctggatcttaagcctagcctttttgctttgcaatttcaagtatcttcatctctaaactagggaaacactgggattctttcttagctgngggggaaggtatttgggta

SEQ ID NO: 58197 - DNA, 295 bp, Homo sapiens
  misc_feature 2: n = A,T,C or G
anctgtgtctttattgtgtgtgtgtgtgaagtgcaggtgtgtgtctttattatattgaaaagctgtcactcagacctggtttgagatagaagagcattttgtccttttgatagttaatagaaattgaaccagagttttcttatgtttgcttgaacagttgtgtaaatcatacaggattttgtgggtattggttgaatatttgtaaaccattccctagcctacatatttattactgaattaactttcctgataaccattgcataattacatttttctataaaatgaaagattatta

SEQ ID NO: 58198 - DNA, 416 bp, Homo sapiens
  misc_feature 14, 26, 27, 28, 383: n = A,T,C or G
cagaaaacatgctncgccagatcatnnntcaggccaagaaacatccgagcttgatccccctctttgtatttattggaactggagctactggagcaacactgtatctcttgcgtctggcattgttcaatccagatgtttgttgggacagaaataacccagagccctggaacaaactgggtcccaatgatcaatacaagttctactcagtgaatgtggattacagcaagctgaagaaggaacgtccagatttctaaatgaaatgtttcactataacgctgctttagaatgaaggtcttccagaagccacatccgcacaattttccacttaaccaggaaatatttctcctctaaatgcatgaaatcatgttggagatctctattgnaatctctattggagaatacaatgattaaatcat

SEQ ID NO: 58199 - DNA, 387 bp, Homo sapiens
  misc_feature 2, 5, 40, 46, 47, 62, 63, 67, 69, 72, 87: n = A,T,C or G
anacnccactaaagggcttttgtcacgtactcataatgtnatctcnnttgttttagctcccnnaacngngancatgcttcccaaaanattacaacatcaaaaccaggaatgtccccgcatctactattaccaggcttgcaattggttcaattttcccataaaaacatgtttgtccaaaagaagggaaactgtgaatttattccatgcatgtaataaactctgcaagaagtttaacccacataggtttgcggcctgcaaaattgttcatgggtctatgtagcaaatgattctctgccttgacaatcatgtatacatatcaagatttctatcataatgataatgagattgatgacttcctgttttcctccaataaagacaattaatcac

SEQ ID NO: 58200 - DNA, 283 bp, Homo sapiens
  misc_feature 9, 10: n = A,T,C or G
taagcgggnnaagtatcttccatgttaatgtgttaagatactgaaaataccagccatcagaaactggtctttctgccaataaagttgcatggtaaatatttcattacagaatttatgttagagctttcatgccaagaatgttttcttacaaaattctctttttattgaggtttcactaataagcagcttctacttttgagcctcaacttaaagcagaactgttttctactggatttttcattaacagcaagctttttcttttatgtaaaataaatctattgtg

SEQ ID NO: 58201 - DNA, 184 bp, Homo sapiens
  misc_feature 7, 49, 51: n = A,T,C or G
gtatgtncacagggtcataatgatgtgactgcttagcccctaaatatgntntactactctgggacaatatgggaggaaaagtgaagattgtgatggtgtaagagctaaatcctcatctgtcatatccagaaatcactatataatatataataatgaaatgactaagttatgtgaggaaaaaaac

SEQ ID NO: 58202 - DNA, 427 bp, Homo sapiens
  misc_feature 13, 56: n = A,T,C or G
aacgaaccacatnaaactcaatgctttatttgtaaatttaagtgtttttttatttntactgtcaaatgatgtgcaaaaccttttactggttgcatggaaatcagccaagttttataatccttaaatcttaatgttcctcaaagcttggattaaatacatatggatgttactctcttgcaccaaattatcttgatacattcaaatttgtctggttaaaaaataggtggtaagatattgaggccaagaatattgcaaaatacatgaagcttcatgcacttaaagaagtatttttagaataagaatttgcatacttacctagtgaaacttttctagaattatttttcactctaagtcatgtatgtttctctttgattatttgcatgttatgtttaataagctactagccaaataaaacatagccaatggc

SEQ ID NO: 58203 - DNA, 458 bp, Homo sapiens
  misc_feature 3, 11, 395, 448, 454: n = A,T,C or G
tgnctccatgnggtccacatcttttgtcttttcttccatgtagagatcgttggcaaaaacattgatgggaattatctatcttgcatttatgtgacatttttaattctttaacagtattgtcatctgtataatcagttatattgcacctggtttccccagtttggtagagcatgcctattgagttttaaagaataaagatgacttattcagaagggcatgctctcagaataacaaactgcatggcatcctgtttgcaaaaatctgcattaggcagatttttgtctgatgatttctttgttatccacatgactttcagggctaaaatgaaatgctcttttttctttaagtcattattcaaaagtaagagagaacggttattataacatatagcttangtgtgcccttgggaaagttggttaaaccaagttaatgatttaatttgcggggngggggngggg

SEQ ID NO: 58204 - DNA, 240 bp, Homo sapiens
  misc_feature 6, 18, 29, 34, 41: n = A,T,C or G
taaccnagatgtcgttcnccatataggtnacgtncgttggncttgaacttctgaccttgtgatccaccccgccttggcctcccaaagtgctgggattacaggtgtgagccaccgtgcccggccaagtaaaatgttttttaaaatggtatgtgcattattcataaaaaataatggtgtccagtctttttaaacttgtaaagacacatcttattgaataaggagatgagagcttaagtttgc

SEQ ID NO: 58205 - DNA, 402 bp, Homo sapiens
  misc_feature 6, 9, 31, 40, 47, 50, 80, 82, 116, 123, 127, 287, 398: n = A,T,C or G
gatgcnttntgccctgattgaggggatatcnccacgcgancccactnttnatacaaactaccatcagagaatactaccancncctctatgcaaataaactagagaatctagaaganatggatnaatncctcgacacatacactctcccaagactaaaccaggaagaagttgaatctctgaatagaccaataacaggagctgaaattgtggcaataatcaatagtttatcaaccaaaaagagtccaggaccagatggattcacagccgaattctaccagaggtacaanggaggaactggaccattccttctgaactattccaatcaatagaaaaagagggaatcctccctaactcatttatgaggccggctcatctgataccaaagccgggcagagacncacc

SEQ ID NO: 58206 - DNA, 458 bp, Homo sapiens
  misc_feature 5, 29, 33, 126, 184, 386, 446: n = A,T,C or G
tccgntaggacctaaatcagaatcatagntgcntgcatatatggtaacaaggtcgtgtgcatttgctttcacagtgatgagtgagaggatgagaagaaattatttgacatttttctgtggttgaanagaagacacctttcttttgtctttaggtttaggaggagatactaagatctggatgttnatcctatcttagtttggttggagtaataagagagaagaagagggtggactttggcttttcagtgttttttcccctaaagagtgatattgctgacgtttctatcaattttacacataatatgtggctatgaaaccatatatctcacttaagtaacaaagtaatcactttgtctatcactaagtaatagacaaaaatcatttgnctattatttaaagcccaccaaacagtgtacaggtttaaggtcaataatggtaagtattgnatagaaatatat

SEQ ID NO: 58207 - DNA, 476 bp, Homo sapiens
  misc_feature 9, 15, 52, 54, 377, 472, 475: n = A,T,C or G
aatataccngggagnattcctgccgataaaagtggaaaatgaggcttaaacntntaaagaaaattgtaattaagttcttagagctaggaagcggcagagatggaattgtgtggtgctgatgtcagaactcgtgtgtttaactatttcactctgttggcatattaagtcctcctttctattcatcgttatgcttatctaatacatgattccaccttgcttaggctgggatacctatgcctgaatatcagcaacctcctggtgatattttctcccatcactcatggaaatggaaaggcagtagaaagtagtgtagagactataaaaatcatacacttagatcaacttgggtgagagacctaactcagtcatttagttgnactgggctttaggataattattctgcatttctataacctcaggttggtaagatgttacatggagctattaataaccctgctactaggattattgngang

SEQ ID NO: 58208 - DNA, 305 bp, Homo sapiens
  misc_feature 6, 15, 41, 43: n = A,T,C or G
cagggnccgcccccngttgtatgtcaggtctgatgtataantntcccagctgtgaaagtgtgacagatgaatatgcaggtcaccttattcagatactaaaacaggaaggtggtaatagtgagttgataatggatcagtatgccaataggcttgcctaccgatctgttaaatcaggattacaggaagcagctaagacaaccaaagtgcagtgcaactcaagaatgttccctgtgccaagttcacaagtgaaaacaaacaaggaactgttaatgttttcaaacaaagagcaccaccaagaagcagac

SEQ ID NO: 58209 - DNA, 292 bp, Homo sapiens
  misc_feature 5, 15, 28, 37, 50, 55, 56, 64, 75, 80, 83: n = A,T,C or G
tggtntatttgaagncatagtgggggcnaattttccngattattgacagncaccnnaccacagntccaggaatgncaganaanataaaacatgataaataagtgtaggtaaatacacctaggaatatcacaattaaactgtagaaaacaaaagacaaagagaaaatcttgaaagcagccagagagagtaaaaacacctaacagatatatgaaaaaagataagaattacatcaaacttcttgcaaaaaccatgcaaacaagaagggagtggagtagaatatttaacacttgac

SEQ ID NO: 58210 - DNA, 260 bp, Homo sapiens
  misc_feature 6, 12, 31, 32, 33, 36, 47, 49, 50, 54: n = A,T,C or G
aaaggngtgatncgcaatcgtgtgtatccgnnngangaaaatggttngnngtangaatgttcgctgatgacctgcacaaccttaataaacgcatccgctatctctacaaacactttaaccgacatgggaagtttcgatagaagagaaagctgagaacttcggaaaaggctcatctgtcaccctggagaagggaaactgtacttttccctgtgaggaaacggctttgtattttctctgtaataaaatggggcttctttcga

SEQ ID NO: 58211 - DNA, 464 bp, Homo sapiens
  misc_feature 3, 11, 30, 55, 423, 447, 459: n = A,T,C or G
aancggccctncaaaatggcggagcgatgnatgtggataccccgagcggcacctncagcggcgcgggcaagaagcgctttgaagtgaaaaagtggaatgcagtagccctctggcctggatattgtggtgataactgtgccatctgcaggaaccacattatggatctttgcatagaatgtcaagctaaccaggcgtccgtacttcagaagagtgactgtcgcatggggagctgtaaccatgcttttcacttccactgcatctctcgctgctcaaaacacgacaggtgtgtccattggacaacagagagtgggaattccaaaagtatgggcactaggaaaagacttcttccatcaagcttaattggtttggtattcatttaatgactttccctgctgtacctaattacaaattggatggaactgngtttttctgctttgtttttcaagnttgctgttctgnagcca

SEQ ID NO: 58212 - DNA, 171 bp, Homo sapiens
  misc_feature 3, 5, 6, 8, 9, 12, 14, 16, 19, 20, 22, 23, 25, 30, 31, 36,45, 52, 65, 168: n = A,T,C or G
ctnanncnnagntnanctnnannanctgcnngacanaaccgcctnaatcccnttgtaaatttaanctgttaggccaaagaggaacagctctttggacactaggaaaaaaccttgtagagagagtaaaaaatttaacacccatagtaggcctaaaagcagccccaattngga

SEQ ID NO: 58213 - DNA, 215 bp, Homo sapiens
  misc_feature 4, 14, 23, 49, 54, 76: n = A,T,C or G
cttnctttttattntaaatcttnaggttctggtaacctgtggtgtattnttatnttcctgtgactgtttttgtttngtttttttcctttttcctcccctttgaccctattcatgtctctacccactatgcacagattaaacttcacctacaaactccttaatatgatctgtggagaatgtacacagtttaaacacatcaataaatactttaactt

SEQ ID NO: 58214 - DNA, 468 bp, Homo sapiens
  misc_feature 6, 26, 36, 39, 41, 45, 80, 81, 86, 94, 97, 420: n = A,T,C or G
acaggngtcggctcaccaagagttanctttcaggcnctngntatnttacagaaggagattataaatattgaatgacactnntacanacaacggngtnccttctgccaaggctacttcctttaacgaagtgcctttaattcagccttatccaactagggaaaataatgttggacaagtctaggatttgaagagtcagtgaacttttagtgtcagggaataaacatggtgggtagattaggtttgaaaaaaacttccttagaggtatttattctcaatacctgcaggggcccatgggaatgacttcagaagcatcccggataatagatgggtaaaaagtctaggcaccctgaagaacaggtgagacagctgcctctggacagaggtaggcatagtcagtaccgatatatcattcctctgggncctaaatatacaaacttattcatgtttttaaggtgatgatgggcattg

SEQ ID NO: 58215 - DNA, 420 bp, Homo sapiens
  misc_feature 10, 12, 353, 360, 365: n = A,T,C or G
ggcggatgcngncgtgaagataggtactggttttggattaggaattgttttctcacttaccttctttaaaagaagaatgtggccattagccttcggttctggcatgggattaggaatggcttattccaactgtcagcatgatttccaggctccatatcttctacatggaaaatatgtcaaagagcaggagcagtgacttcacctgagaacatcccagcgggaggacaagagaaatcatgtttattcctcaggaatactgaagtgccctggagtaagctgcattcttctgtaacaatgttatcagtaatgctttaaactccagcacctggttatgcatttgaaaccaagtctgnttcttgntttgnattttctctctggaagttgtaaggaggtggcttaaataaattaaacaaaaatagg

SEQ ID NO: 58216 - DNA, 144 bp, Homo sapiens
  misc_feature 6, 8, 27, 31, 33, 140: n = A,T,C or G
tctaantnattttatgagggcagcatnaccntnatttcaaaaccagacaaggacacaagaaaaatagcaaatgacaggccaatatttctaatgaacatagactcgaaaatcctcaacaaaatactagtaaaccgaatgtnactt

SEQ ID NO: 58217 - DNA, 270 bp, Homo sapiens
  misc_feature 75: n = A,T,C or G
gacatttctatatgagtgggtttactggtaaattatgttattttttacaactaattttgtactctcagaatgttngtcatatgcttcttgcaatgcatattttttaatctcaaacgtttcaataaaaccatttttcagatataaagagaattacttcaaattgagtaattcagaaaaactcaagatttaagttaaaaagtggtttggacttgggaacaggactttatacctcttttactgtaacaagtactcattaaaggaaattgaatg

SEQ ID NO: 58218 - DNA, 231 bp, Homo sapiens
  misc_feature 18, 21, 29: n = A,T,C or G
gtttttttctctttgaanganagagattnatacaactacttaaaaaatataggtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgttttt

SEQ ID NO: 58219 - DNA, 256 bp, Homo sapiens
  misc_feature 8, 30, 56, 60, 61, 62, 64, 67, 68, 69, 74, 82, 85, 90, 91,108, 117, 147: n = A,T,C or G
catatagnctgtgcgaggccagagatttangagactgaaacagtttactttaaacngttnnnanctnnngccantagactcnatntgctnnaaaaaataaaaattgtncaacccagngttctccagcatcaggacattacagttggnaatctatgttgtaatcttttcaaataagaaaagctctccttattctctacagtgtaggcttaattttagaccgataatttactatatctgcattattgatatttttaag

SEQ ID NO: 58220 - DNA, 314 bp, Homo sapiens
  misc_feature 45, 47, 49: n = A,T,C or G
caggaggtgaggtttaattgcaggtgccagtttgctgatggtcgntntnagttggagttagtatgttcaacagaccccattagcagaagtcatgttccagcttagactgatgaagaattaaaaatctgcatcttccactattttcaatatattaagagaaataagtgcagcatttttgcatctgacattttacctaaaaaaaaagacaccaaacttggcagagaggtggaaaatcagtcatgattacaaacctacagaggtggcgagtatgtaacacaagagcttaataagaccctcatagagcttgattcttg

SEQ ID NO: 58221 - DNA, 462 bp, Homo sapiens
  misc_feature 17, 24, 25, 26, 31, 42, 43, 54, 58, 66, 324, 382, 387, 423: n = A,T,C or G
gtgtcgtgcgccccganaatcatnnntatcncagaaacttannctttaaattanatgncgtgcacnggactgtgtgaaagaagatgctttgcatatttgctgcactgcatcagtatcttactaaaaatgtgaaatgaaaggactattgtacactgaaatgcttaaatgtatctgaaagcacaaggtgatactcatttttatggcttcccacttgtgctggtttttgcctctttgacatctgtcatcagtatttagagggtgagaagtgaatgtaacaggtataaataacatttttaaaaacaataactttgctataatcacagntgtccagagcactgcagatacattctaatgaccagaactgggttaaaaaaagaaaatncaccntgggaaagaaatcttaaatgaaaacgcatctcatgnaggcatttttgcctcatttttactgggccatgttggttt

SEQ ID NO: 58222 - DNA, 422 bp, Homo sapiens
  misc_feature 56: n = A,T,C or G
cttctagaaaactccaagataaaagggagaggtttctctaaattgaaacaactgangaagctgcatataaaccacaacaacctgacagagtctgtgggcccacttcccaaatctctggaggatctgcagcttactcataacaagatcacaaagctgggctcttttgaaggattggtaaacctgaccttcatccatctccagcacaatcggctgaaagaggatgctgtttcagctgcttttaaaggtcttaaatcactcgaataccttgacttgagcttcaatcagatagccagactgccttctggctccctgtctctcttctaactctctacttagacaacaataagatcagcaacatccctgatgagtatttcaagcgtttaatgcattgcagtatctgcgtttatctcacaacgaactgg

SEQ ID NO: 58223 - DNA, 470 bp, Homo sapiens
  misc_feature 5, 26, 45: n = A,T,C or G
gaaangtcgctatactatagaatacnaatgacaattcatttatgnccactcaaacagcgttagtaaccatttagtgacaaaggattaaaacatccatctggatgttaattttgaagatgtaaattatatgttgtttaaatttttccaggcatctgaaaaccttatctgctagacaatgtaagattcacacagagttatctgggattctgattttttaaatagtacatatcattaaaccattttctctaaatgtaagaagagcagaaaaaatcttataagattatcagatttttctaatgacacagaaatgtaagaaaaaaatccctttatattgaaaaaagatgcagtcaaagcttttcagacatgcccaaactttgagaatttcttcaaccatctaatgctataaaggatttttggtcttcctgttcacaaccagttgtataacagaaatctagctactggtttccttc

SEQ ID NO: 58224 - DNA, 238 bp, Homo sapiens
  misc_feature 22, 34, 39, 40, 46, 49, 51: n = A,T,C or G
tgtgccgcgcactctataatcntcctatggctancctcnnggaggngcncncccgatgattttacttctttgccatcagcaagagtaggatttcatcaaggcaaggtaggaatctaaatgaaattgatatataaatgaattgatctaaatgtaaaagcaaatgaaaaatgcatgtgttttttcctgtcaaacatgtatacccttatgtatagagaccagtagtcacgtatggtgactg

SEQ ID NO: 58225 - DNA, 458 bp, Homo sapiens
  misc_feature 4, 8, 34: n = A,T,C or G
cccnagangtctcgctccgtggccttagctgttntcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgcacagcccaagatagttaagtgggatcgagacatgtaaagcagcatcatggaggtttgaagatgccgcatttggattggatgaatccaaatctgcttgcttgctttttaatattgatatgcctatacactt

SEQ ID NO: 58226 - DNA, 460 bp, Homo sapiens
  misc_feature 12, 79, 372, 414, 428, 450, 459: n = A,T,C or G
ccggtggcgcgnttcccgagagatgttttacttttcacagtatggtttacacagcagctgttcaacaagagtaaatatngtcacaacactgaacctctggctagaggacatattcacagtgaacataactgtaacatatatgaaaggcttctgggacttgaaatcaaatgtttgggaatggtgcccttggaggcaacctcccattttagatgtttaaaggaccctatatgtggcattcctttctttaaactataggtaattaaggcagctgaaaagtaaattgccttctagacactgaaggcaaatctcctttgtcatttacctggaaaccagaatgattttgcatacaggagagctgcagttgtgaaagcnccatcatcatagaggatgatgtaattaaaaaatggtcagtgngcaaagaaaggacngcctgcatttctttatttctgnccataatgnc

SEQ ID NO: 58227 - DNA, 457 bp, Homo sapiens
  misc_feature 12, 14, 41, 273, 340, 426: n = A,T,C or G
gccaagactttntnctgtaaatacatcaacttccgaaacgngccggagattgctgtgtaccctgcctttgaagcacctcctcagtacgttttgccaacctatgaaatggccgtgaaaatgcctgaaaaagaaccaccacctccttacttacctgcctgaagaaattctgcctttgacaataaatcctataccagctttttgtttgtttatgttacagaatgctgcaattcagggctcttcaaacttgtttgatataaaatatgttgcttttgnttaagcatttattttcaaacactaaggagctttttgacatctgttaaacgtctttttggttttttgntaagtcttttacattttaatagtttttgaagacaatctaggttaaagcaagagcaaagtgccattggttgcctttaattggggggngggaagggaaagaagggacttgccacatagt

SEQ ID NO: 58228 - DNA, 255 bp, Homo sapiens
  misc_feature 8, 25, 44: n = A,T,C or G
cggagganctggactgtcctggcancgaactctccctctgtgtnttattggaggagaccacaagctgttgttttgggtgactgaagtataaagtgttttctgtaccttagattcacaaactttgtatttttagtacatattttgaagaatttctatagtacatattttgaagaatttttatatcaaatataccgtatactttagaaaatgtctcagttgcttttattaaataaaatgttgatggtttgaaaaatt

SEQ ID NO: 58229 - DNA, 438 bp, Homo sapiens
  misc_feature 9, 411: n = A,T,C or G
cacatgacnttttgttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgcgcagggagaattgcgtcatttaaagcctagttaacgcatttactaaacgcagacgaaaatggaaagattaattgggagtggtaggatgaaacaatttggagaagatagaagtttgaagtggaaaactggaagacagaagtacgggaaggccgaagaaaagaatngagaagattgggaaattagaagataat

SEQ ID NO: 58230 - DNA, 478 bp, Homo sapiens
  misc_feature 18, 30, 362, 418: n = A,T,C or G
tagtgctcccagaaagcngacggaatgccnagatcctagctgccttgttggttttttaggatttccatctttttacaagatgagaagttacagttcatctcccctgttcagatgaaacccttgttttcaaaatggttacagtttcgtttttcctcccatggttcacttggctctgaacctacagtctcaaagattgagaaaagattttgcagttaattaggatttgcattttaagtagttaggaactgcccaggttttttttgttttttaagcattgatttaaaagatgcacggaaagttatcttacagcaaactgtagtttgctccaagacaccattgctccctttaatcttctcttttgnatacatttggtacccatggtgtctttgttccttttcataagctaataccactgtangggatttggtttgaacgcatattgacagcacgctttacttagtaagccgggtcccatttg

SEQ ID NO: 58231 - DNA, 327 bp, Homo sapiens
  misc_feature 9, 34, 56: n = A,T,C or G
aaggtcgcnaaaaaaaggtcttggtgaggtgccngccatttcatctgtcctcattntctgcgcctttcgcagagcttccagcagcgaatttgccattttcagtggaaaacaagtggtcgttactagctaagatgtgtttgtactttggatctgcatttgctacacccttccttgtagtaagacaccaactgcttaaaacataaggatgtttcagttcctccatttaacagatatgaagagcattttaagaggtgcagcctctggaagtggatcaaactagaactcatatgccatactagatatgtttgcaataaacttatgacgtgg

SEQ ID NO: 58232 - DNA, 152 bp, Homo sapiens
  misc_feature 6, 17: n = A,T,C or G
ataaanacccacagctnacaacataatagcaaaacattgaaaatttttcccctaatatcatgaaaattcctgatttccccactgctattcaacattatactagaaggtctagccagagcaattaggcaagaaaaagaaataaaatgaatccc

SEQ ID NO: 58233 - DNA, 457 bp, Homo sapiens
  misc_feature 7, 11, 36: n = A,T,C or G
tctgccngagntgacttctaagtaaaaccacagcanttgaaaagactccaaagaaatgtaagggaaactgccagcaacgcaggcccccaggtgccagttatggctataggtgctacataaacacagcaagggtgatgggaaagcattgtaaatgtgcttttaaaaaaaaatactgatgttcctagtgaaagaggcagcttgaaactgagatgtgaacacatcagcttgccctgttaaaagatgaaaatatttgtatcacaaatcttaacttgaaggagtccttgcatcaatttttcttatttcatttctttgagtgtcttaattaaaagaatattttaacttccttggactcattttaaaaaatggaacataaaatcaatggtatgtattattattcccattctacatactatggaatttctcccagtcatttaataaatgtgccttcattttttcc

SEQ ID NO: 58234 - DNA, 469 bp, Homo sapiens
  misc_feature 20, 32, 42, 48, 49, 50, 51: n = A,T,C or G
caggaggcgtggctaccganatttaatgatanttcatgacanaatttnnnntgctaaatttgaaaaggagaaaatgaatgccaaatgggacacgggtgaaaatcctatttataagagtgccgtaacaactgtggtcaatccgaagtatgagggaaaatgagtactgcccgtgcaaatcccacaacactgaatgcaaagtagcaatttccatagtcacagttaggtagctttagggcaatattgccatggttttactcatgtgcaggttttgaaaatgtacaatatgtataatttttaaaatgttttattattttgaaaataatgttgtaattcatgccagggactgacaaaagacttgagacaggatggttattcttgtcagctaaggcacattgtgcctttttgccttttcttcctggctattgaaatcaagcttattggattaagtgatatttctatagcgattgat

SEQ ID NO: 58235 - DNA, 373 bp, Homo sapiens
  misc_feature 8, 21, 30, 40, 43: n = A,T,C or G
taaacccnaactggagataanttcgcaagnagagccaaanctnagaccggcgtttccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaaatttaacacccatagtaggcctaaaagcagccaccaattaagaaagcgttcaagctcaacacccactacct

SEQ ID NO: 58236 - DNA, 209 bp, Homo sapiens
tgattactatgccttttctaaagatcattactataacattgatgtgcctagtagaacagcaagagcaattactactcgttctgggcagaccttatccaaagtctggtacaactgtccttagactgatgagcaaaggaggagtcaactaatgaagaaatgaataataaattttgacactgaaaaacattttattaataaagaatattggc

SEQ ID NO: 58237 - DNA, 484 bp, Homo sapiens
  misc_feature 1, 18, 30, 31, 35, 38, 39, 40, 41, 46, 48, 51, 58, 62, 64,65, 70, 71, 79: n = A,T,C or G
naatgaacccgaggatgncctagtttcagnncagnaannnncgaanantgngacactntccngnngtcgnnctgacgtnagtattaacaacacaagatatttttgaggatgatatatttgctacggaagcaattaaaccctctcagaaaaccagagagaaggagaaaacattggaatctaatttatttgatgataacattgatatctttgctgacttaactgtaaaaccaaaagaaaagtccaaaaagaaagtggaagccaagtctatatttgatgatgatatggatgacatcttctccactggtatccaggctaagacaaccaaaccaaaaagccgatctgcacaggccgacctgaaccaagatttgaacacaaggtgtccaacatctttgatgatcccctgaatgcctttggaggccagtagagcacacagggtatccacatgttaccctgcagctacattgttgagttagtgatgatattg

SEQ ID NO: 58238 - DNA, 290 bp, Homo sapiens
  misc_feature 5, 9, 27, 33, 44, 47, 48, 49, 51, 53, 54, 55, 56: n = A,T,C or G
ccacncaangcgatgatgtctgtagtnaagaangcatctcaggnggnnnancnnnnatttctcagttcacaccagaaagtattgaagccacactttcaatattatctcgtaaacatgtagaagatgttgggaaaaatgattttctgcagtcggagcggtgtgcaaatggattaggaaatgataactccagtaacactttaaatactgactattcattcttagaaattaataataagaaagaaagaattgagcaacagctaccaaaagaacaagccttgctccaagatccc

SEQ ID NO: 58239 - DNA, 129 bp, Homo sapiens
  misc_feature 10, 23, 53, 92, 94: n = A,T,C or G
ctgataggtntgcgctcgcaganctcgtcgttgggctggagaggtctggtttngctgagctccgcaaggaggatcaacatgccttgcggctntnagatttactacatccgtccttggaagaggaaaaga

SEQ ID NO: 58240 - DNA, 449 bp, Homo sapiens
  misc_feature 1, 10, 29: n = A,T,C or G
ngtttacganaatgactctggttaacttnttaattaaacattcaataaaatcacctttatgcctacatcagtaatttaaatgaatcatgttttgaaagttttttaaaaaagaaaaggtagtaggtttcagagcttgaattgaatacccaacaaaattctaaacccttatttagcaactgcttaataagaaattgtaaaataatcaagaataaatccaaatactgtaaaatggattggtaggcttatagataagaggaattctatagatatgctgtttatgaactgaaggtcatttgatgtcattattgaaaaaaatgaggccgggtgcggtggctcacgcctgtaatcccagcactttgggaggctgaagcaggcggatcaagaggtcaggagtttgagaccacctggccacatggtgaaaccctgctgtactaaaaatacaaaaatta

SEQ ID NO: 58241 - DNA, 226 bp, Homo sapiens
ctcgccaatcgtagtgacttcagctaacgaaatgttcttttgtagtaccatggtcctcggcctaacgaaggacgtgaaccttgtaagaggagagctctgaaacgtggtcacctttgtttagtggaagggaaagtgtgttcctggcatgaggtgcctcggaattagtaaagaattgtgggcaatggattaaccactgtatctaagaatccaccaattaaagcatttg

SEQ ID NO: 58242 - DNA, 109 bp, Homo sapiens
  misc_feature 11, 14, 30, 42, 47: n = A,T,C or G
cttgggaaaanatntctttgtattctctgnccagggcttcanatatnggagcacgaattttaaaacatggcaataaatggctcgtgggctccggctccctgggaccccc

SEQ ID NO: 58243 - DNA, 447 bp, Homo sapiens
  misc_feature 10, 342, 351, 407: n = A,T,C or G
tatggttttnaattttaaaaaaagcttttaggtattgccattccttagcatccttattgattatgggtgatgagtttttaactcttaaaatcatatacgtgtattagtttatcttaactgttgccctaagcaaaagggaaggtatacacctaagggatgtacttattttgcatttttggtcatgggtgggaatggggtgggtgcctacttaaatagtttttaaaaaagaaaaaaatcacaaatatttttctactgttatatatgatcttcctttatactagtttctctctagtaaggcatgccagaagcccaagatccatatcatgaattcttacatattgnaccttttgntggtgggtaaatcgcatcagatgcttgcattgctgccataattataaaatgcttgnaaaggatcaaatatcactaaatctttaaattggtttactt

SEQ ID NO: 58244 - DNA, 300 bp, Homo sapiens
  misc_feature 6, 18, 49, 50, 52, 55, 59, 66, 69, 80, 298: n = A,T,C or G
gtgagntcgcagttgcgntggacagggcactttgtggtgttggggtggnncnttnctcnatctctngtntgtttcttgtnttttaataatgtttacaatctgcctcaatcactctgtcttttataaagattccacctccagtcctctctcctcccccctactcaggcccttgaggctattaggagatgcttgaagaactcaacaaaatcccaatccaagtcaaactttgcacatatttatatttatattcagaaaagaaacatttcaagtaatttataataaagagcactattttttntt

SEQ ID NO: 58245 - DNA, 277 bp, Homo sapiens
  misc_feature 5, 19, 30: n = A,T,C or G
gcatnatgccctgatatgnggagggttcgnaatgcgagcttatttttaccaaagacttgttaaatgtatacaccaagcggtaatgaaatttcggtgactggcccacacgtgcatagaggtctgggaggaccaggaaacagcctcagtggccagaggatcaccagtgcatccttcatcacagcatgtgcaatatgccaagattaccctcggtcattcctgtcaacaaggggtcaatgtcataaatgtcacaataaaacaatctcttctttttttagtc

SEQ ID NO: 58246 - DNA, 256 bp, Homo sapiens
  misc_feature 17, 44: n = A,T,C or G
cctttgtgcttttgccnttttatggtgcttaaagtaaagagccnttcctttgcaagtcatccatgttgttacttaggcattttatcttggctcaaattgttgaagaatggtggcttgtttcatggtttttgtatttgtgtctaatgcaccgttttaacatgatagacgcaatgcattgtgtaagctagttttctggaaaagtcaatcttttaggaattgtttttcagatcttcaataaattttttctttaaatttc

SEQ ID NO: 58247 - DNA, 393 bp, Homo sapiens
  misc_feature 5, 16, 42: n = A,T,C or G
gctgngctctctctantgatacttttctcctgcatgcatatnatatgaagcaaattattcagtttttcttctagtattattttcattgaagtcccaacatgctcgttaatagcaaggctggaatcactgtgttggtacagttctgtagtgtcttgttttacttaactataagtcattaaagtttgtgaacagagaattttaacttcaagtgcattttaccagatgcataccaagacaaaacagaatgtcctatgatattttgattcactataaatcctacttaatttagtgtaaattctttaaccctacaatattttcaaatgtcagacatatatgaaaatgtaaaatcattctttaacgttaagcatgcattctaacagttcggtctacttt

SEQ ID NO: 58248 - DNA, 467 bp, Homo sapiens
  misc_feature 42, 43, 50, 80, 85, 86, 351, 366, 426, 448, 458, 459: n = A,T,C or G
cacaggggtccgcttcccagtatatgtactgtgcgatgttannttttacnagcatgtaccccggacacgggaggctgctncgccnngacccgacgggaaggttttccagtttcttaatgcgaaatgcgagtcggctttcctttccaagaggaatcctcggcagataaactggactgtcctctacagaaggaagcacaaaaagggacagtcggaagaaattcaaaagaaaagaacccgccgagcatgtcaaaattccagagggccattactggtgcatctcttgctgatataatggccaagaggaatcaagaaacctggagttagaaaggctcaacgagaacaagctttcanggctgcttagggagncaaaaaggctaagccagcatcttaaaagactgcaatggctgctgctaagccccttccaangcagccctaagccaaagaatgngaagcctgtnnaagttcag

SEQ ID NO: 58249 - DNA, 263 bp, Homo sapiens
  misc_feature 7, 47: n = A,T,C or G
cgaaaancattaaacacagtgggaatatcacttttgatgagattgtnttcattgctcgacagatgcggcaccgatccttagccagagaactctctggaaccattaaagagatcctggggactgcccagtcagtgggctgtaatgttgatggccgccatcctcatgacatcatcgatgacatcaacagtggtgctgtggaatgcccagccagttaagcacaaaggaaaacatttcaataaaggatcatttgacaactggtgaag

SEQ ID NO: 58250 - DNA, 315 bp, Homo sapiens
  misc_feature 9: n = A,T,C or G
aatagttantaacaaacatccttgtcactgagtggaatgaaacattcattaaaaactgtttaattttctcagtgtgaggcatttcatttgtaaggcagcaaacaagaagagagaaagaaggagaaacaaattttgtgatttgttttctatgaaagaaaaaggttaaatgtatgttttcatttttttatgtttctacttcatgttttaaaaaattattcattagtttcctttggaaaacttgggtcaaatcattcttctgaatgtccattagaattcctgtgattcagaaaaattttagatcctcaactttatttt

SEQ ID NO: 58251 - DNA, 411 bp, Homo sapiens
  misc_feature 9, 17, 336, 388: n = A,T,C or G
cataggttnaaatgctnaagtagcttaaaaagttgtcatagtttcagtaggtcatagggagatgagtttgtatgctgtactatgcagcgtttaaagttagtgggttttgtgatttttgtattgaatactgctgctgttacaaagtcagttaaaggtaccgttttaatatttaagttattctatcttggagataaaatctgtatgtgcaattcaccggtattaccagtttattatgtaaacaagagatttggcatgacatgttctgtatgtttcagggaaaaatgctttaatgctttttcaagaactaacacagttattcctatactggatttaagnctctgaagaactgctggggttaaggaataagaatgtgcatgaagcctaaaanccaagaaagcctatactgaattt

SEQ ID NO: 58252 - DNA, 446 bp, Homo sapiens
  misc_feature 4, 22, 27, 28, 31, 32, 37, 55, 64, 350, 386: n = A,T,C or G
taanaaacccgggaaaatcgcngaccnnggnngaganatgtggagaagaaagcanttagactangaccgcagtgtgtaggtgtgctaaggtagagtccgcttggagactgttggcatgctagcccaaggaggacatatgaagggaagctgattttctgggcacgaaagtactgccccttctcctctcctaacgcacccaccactgagatttgtccattacacctgtatcatctacagaaagtaaaggcctgccaagcacgggaagcacctgggaggccagggaaatgctggtggtatgcatcaacttccatgagtgtcacccagggtactttggtaaagttgggtatgangcattacctcttaaagagaaaccagagcttctgccnactcttgccttgcaaatgtggccttggcagtcaggagacatgagtaatcacacgctggcc

SEQ ID NO: 58253 - DNA, 461 bp, Homo sapiens
  misc_feature 2, 33, 39, 45, 47, 52, 106, 108, 177, 436: n = A,T,C or G
cntgtgcccgcctccgagaacctttgctacagncaacgntacttngnaagcnaaatctgtcgaaatgcaccatgaagctttgagtgaagctcttcctggggacaangngggcttcaatgtcaagaatgtgtctgtcaaggatgttcgtcgtggcaacgttgctggtgacagcaaaantgacccaccaatggaagcagctggcttcactgctcaggtgattatcctgaaccatccaggccaaataagcgccggctatgcccctgtattggattgccacacggtcacattgcatgcaaagtttgctgagctgaaggaaaagattgatcgccgtctggtaaaaagctggaagatggcctaaattcttgaagtctggtgatgctgccattgttgatatggtcctgcaagcccatgtgtgttgagagcttctcagactatncaccttgggtcgctttgctgtcgtg

SEQ ID NO: 58254 - DNA, 240 bp, Homo sapiens
  misc_feature 7: n = A,T,C or G
aaagganggaatctttccaagattcctcactctgaccacgtggtactttggcacagggctgacacttcctagagtggctacttctacttgaagggaactgagaagggctacatttggcccaagagctagctagacagccacatgaacagtctcttgcccttccttctggaattctgagtctcatctgccccttatcgaccatgtgcaagccactgccctcttccaagcctcagtttcctc

SEQ ID NO: 58255 - DNA, 221 bp, Homo sapiens
  misc_feature 40, 46, 73: n = A,T,C or G
acatgatgtgtatcatatttgaagtgtggtttttctcaanttcatngactttaaggagctcatttctgaacanaaaggtttgctctgtggaaaaatcaatcactgccaggattctttcatttctgtactattttgtataattgaatttgttcacttctctcacaccagcaagtgttttacaggtgccttggattaaaacaaaattgattttaagaaaaaac

SEQ ID NO: 58256 - DNA, 402 bp, Homo sapiens
  misc_feature 14, 28, 42, 47: n = A,T,C or G
cgttagtactttantcaggaaggacgtnggagttgaggttancattnttatcaaggacagtaactaccatggcttccgaagttttgccaaaacctcggatgcgtggccttctggccaggcgtctgcgaaatcatatggctgtagcattcgtgctatccctgggggttgcagctttgtataagtttcgtgtggctgatcaaagaaagaaggcatacgcagatttctacagaaactacgatgccatgaaagattttgaggagatgaggaaggctggtatctttcagagtgtaaagtaatcttggaatataaagaatttcttcaggttgaattacctagaagtttgtcactgacttgtgttcctgaactatgacacatgaatatgtgggctaagaaatagttcct

SEQ ID NO: 58257 - DNA, 214 bp, Homo sapiens
  misc_feature 5: n = A,T,C or G
aacangctaataaaacgggtagcacttttcttgctttactatacatctttttgtttttgagtgcagaaataaaaaagaaggggaatcaaaagagaaacagtgaaaatgttgggaacagtgaaaaatgctttgagagcaggctattattgggaaagatgattatactgcacaaccatttaatgcttactttccagggtttttttaatggtcaatt

SEQ ID NO: 58258 - DNA, 447 bp, Homo sapiens
  misc_feature 3, 6, 29, 32, 72, 275: n = A,T,C or G
canaantctctttggaataaggattttgnttnactcccttagagccctaacagtataccttagaaattattntagacagtttgtacttaaagaccagaaagctactttagagacttggaaataatgagcctattgtcaaaaggtggtgcttgcggggcattaggactagagggttggtgaaaattcagacagaatgtaacttgcaaagagaagacagcaacaactgtaacaattatcttatgaatatttgcgaaactcaaagggatctgattggngcctctgggctttatcaaattaacatcacaacttctagaagaaagtcaaccttcatcttttacaatagaaatcatatgttttgctaacccattcctatttaggctggaaacaattaaagagttatgggacttaaaaaaatcattatggttataaaattagtgatagaaggag

SEQ ID NO: 58259 - DNA, 391 bp, Homo sapiens
  misc_feature 388: n = A,T,C or G
accgctcagtattttaaatgaagcgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggggggtgattatttgttatnctg

SEQ ID NO: 58260 - DNA, 453 bp, Homo sapiens
ggaatacagggagagagcaagcagcgagtcttgaagctctgtttggtgctttggatccatttccatcggtccttacagccgctcgtcagactccagcagccaagatggtgaagcagatcgagagcaagactgcttttcaggaagccttggacgctgcaggtgataaacttgtagtagttgacttctcagccacgtggtgtgggccttgcaaaatgatcaagcctttctttcattccctctctgaaaagtattccaacgtgatattccttgaagtagatgtggatgactgtcaggatgttgcttcagagtgtgaagtcaaatgcatgccaacattccagttttttaagaagggacaaaaggtgggtgaattttctggagccaataaggaaaagcttgaagccaccattaatgaattagtctaatcatgttttctgaaaacataaccagccattg

SEQ ID NO: 58261 - DNA, 141 bp, Homo sapiens
aagaacatctaccaaaataattctattgcaattatatttaatggtgagagactggatgctttcttcctaagactgggaataaggtaaggacgtccacactcaatattcttattcaacatagtactggaagttctattcaat

SEQ ID NO: 58262 - DNA, 301 bp, Homo sapiens
  misc_feature 24, 153, 294: n = A,T,C or G
tatggatacaatgctgcctatacncgctacttcaggaagcgccgagggaccaaatgagactgagggaagaaaaaaaaatctctttttttctggaggctggcacctgattttgtatccccctgtagcagcattactgaaatacataggcttatntacaatgcttctttcctgtatattctcttgtctggctgcacccctttttcccgcccccagattgataagtaatgaaagtgcactgcagtgagggtcaaaggagagtcaacatatgtgattgttccataataaacttctggngtgatac

SEQ ID NO: 58263 - DNA, 453 bp, Homo sapiens
  misc_feature 6, 32: n = A,T,C or G
gacaancattgttgtatgcccgatacactgtnaactttaaaataaccataaggcaaaaaagccaaagatttttctggaatggaatggtttagaaatacaattagattttctgaaaatgtgtgattttttgctgttgtttagacagcactgaatgtgagagaaaaaagaaatgtaatttgaggaatttttcttcctatcatttagcaattttagttctcacaataactgccacttgaatgttactgtcggacttgtctttttactttttttacatatgacatacttcatatagatactttcaaataaaagtgtattagtgtaaattttatgagaatagtgtgttcctgagatacagtacatcagtattcgtctttttaggcaaggctctgacactccctgcccctgatgcaggtattggatatcaaagaaagaaacaaaacaaacaacctgtac

SEQ ID NO: 58264 - DNA, 500 bp, Homo sapiens
caaggacggatgatgaagtagtacagagagaggaagaagctattcagttggatggattaaatgcatcacaaataagagaacttagagagaagtcggaaaagtttgccttccaagccgaagttaacagaatggtgaaacttatcatcaattcattgtataaaaataaagagattttcctgagagaactgatttcaaatgcttctgatgctttagataagataaggctaatatcactgactgatgaaaatgctctttctggaaatgaggaactaacagtcaaaattaagtgtgataaggagaagaacctgctgcatgtcacagacaccggtgtaggaatgaccagagaagagttggttaaaaaccttggtaccatagccaaatctgggacaagcgagtttttaaacaaaatgactgaagcacaggaagatggccagtcaacttctgaattgattggccagtttggtgtcggtttctattccgccttccttgtagcagataag

SEQ ID NO: 58265 - DNA, 406 bp, Homo sapiens
  misc_feature 136: n = A,T,C or G
ccatcggtccttacagccgctcgtcagactccagcagccaagatggtgaagcagatcgagagcaagactgcttttcaggaagccttggacgctgcaggtgataaacttgtagtagttgacttctcagccacgtggngtgggccttgcaaaatgatcaagcctttctttcattccctctctgaaaagtattccaacgtgatattccttgaagtagatgtggatgactgtcaggatgttgcttcagagtgtgaagtcaaatgcatgccaacattccagttttttaagaagggacaaaaggtgggtgaattttctggagccaataaggaaaagcttgaagccaccattaatgaattagtctaatcatgttttctgaaaatataaccagccattggctatttaaaacttg

SEQ ID NO: 58266 - DNA, 410 bp, Homo sapiens
caagcacaaaactggaaatgattgggtccctgtgaccatcattgatgtcagaggacatagttatttgcaggagaacaaaatcaaaactacagatttgcatagacctttgcatgatgagatgcctggtaatagaccagatgttattgaatccattgattcacaggttttacaggaagcacgtcctccattagtatccgcagacgatgagatatatagcacaagtaaagcatttataggacccatttacaaaccccctgagaaaaagaaacgtaatgaagggaggaatgaggcacatgttctaaatggtataaatgacagaggaggacaaaaagagaaacagaaatttaactctgaaaaatcagagattgacaatgaattattccagttttacaaagaaattgaagagctta

SEQ ID NO: 58267 - DNA, 332 bp, Homo sapiens
  misc_feature 31, 33: n = A,T,C or G
gatctgcttccaatgtgtccatttggatgtntntgctattcacgagttgtacattgctcagatttaggtttgacctcagtcccaaccaacattccatttgatactcgaatgcttgatcttcaaaacaataaaattaaggaaatcaaagaaaatgattttaaaggactcacttcactttatggtctgatcctgaacaacaacaagctaacgaagattcacccaaaagcctttctaaccacaaagaagttgcgaaggctgtatctgtcccacaatcaactaagtgaaataccacttaatcttcccaaatcattagcagaactcagaattcatga

SEQ ID NO: 58268 - DNA, 485 bp, Homo sapiens
  misc_feature 6, 32: n = A,T,C or G
gttctntttgaggaagaagcggtcgtaaggtntgaggatttttggtccgcacgctcctgctcctgactcaccgctgttcgctctcgccgaggaacaagtcggtcaggaagcccgcgcgcaacagccatggcttttaaggataccggaaaaacacccgtggagccggaggtggcaattcaccgaattcgaatcaccctaacaagccgcaacgtaaaatccttggaaaaggtgtgtgctgactttgataagaggcgcaaaagaaaagaatctcaaagtgaaaggaccagttcgaatgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggaagtcaccattgcagatgctt

SEQ ID NO: 58269 - DNA, 484 bp, Homo sapiens
  misc_feature 3, 7, 27: n = A,T,C or G
ctntaanccgtgccctgctacagaagnttgtagttgccgcagcccccaggctgagcacagggtctggaacagaaatctgacagtgatgaatcagtaccagagcttgaagaacaggattccacccaggcaaccacacaacaagcccagctggcggcagcagctgaaattgatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtctacaagagccctgcttcagatacttacatagtttttggggaagccaagatcgaagatttatcccagcaagcacaactagcagctgctgagaaattcaaagttcaaggtgaagctgtctcaaacattcaagaaaacacacagactccaactgtacaagagg

SEQ ID NO: 58270 - DNA, 314 bp, Homo sapiens
  misc_feature 5, 9, 28: n = A,T,C or G
agtcncggnagataagataatgccctcnttaaagcagccggtgtaaatgttgagcctttttggcctggcttgtttgcaaaggccctggccaacgtcaacattgggagcctcatctgcaatgtaggggccggtggacctgctccagcagctggtgctgcaccagcaggaggtcctgccccctccactgctgctgctccagctgaggagaagaaagtggaagcaaagaaagaagaatccgaggagtctgatgatgacatgggctttggtctttttgactaaacctcttttataacatgttcaataaaaagctgaac

SEQ ID NO: 58271 - DNA, 500 bp, Homo sapiens
  misc_feature 9, 21, 29, 33, 35, 40, 41, 44, 52, 53, 60, 61, 62, 68, 71,73, 79: n = A,T,C or G
tctatatanagaaatgtcacncctcggtntctnanggagnnggngtgtctcnntactgcnnngagggnggngnaaacanttactgaagtgatccatggagagccaattattaaaaaatacaccaaaatcattgatggagtgcctgtggaaataactgaaaaagagacacgagaagaacgaatcattacaggtcctgaaataaaatacactaggatttctactggaggtggagaaacagaagaaactctgaagaaattgttacaagaagaggtcaccaaggtcaccaaattcattgaaggtggtgatggtcatttatttgaagatgaagaaattaaaagactgcttcagggagacacacccgtgaggaagttgcaagccaacaaaaaagttcaaggatctagaagacgattaagggaaggtcgttctcagtgaaaatccaaaaaccagaaaaaaatgtttatacaaccctaagtcaataacctgaccttagaaaattgtga

SEQ ID NO: 58272 - DNA, 463 bp, Homo sapiens
  misc_feature 9, 11, 29, 30, 427: n = A,T,C or G
accctcggncnttatggaccgggtatgtnnatcacatctattgtctcctacattttctgcatttgtgcagggcggagccttcctatgaacaacctcaagaaatttcctacttaccttcaccaagcatttctacctgtgtctgggatgcctcttgctgaagcacttgctggcactctgagacactctgagtaccagtcttgagagaccattttcttctttctgtgtcttttaatgagtaatgagagttctagcaggaaggcatttcaaattattcttttatggtgctggacactgaacagaagggagattatgacctggtctctcttgcgtgttctgaggaacggtagacctggaggcgctattgaaaaaaatatcctgtggttagatatggtttagaaatattgttctgtatcccatttattgcagngttcatcagtatactagagatttgaccaaagtaccc

SEQ ID NO: 58273 - DNA, 361 bp, Homo sapiens
  misc_feature 8, 13, 84, 88, 90, 92: n = A,T,C or G
ggaagcangtggntacattcgttgaaggactccagctgcggaatttgcggctttggccgattgaaatcgtggcaggtccaaaangtgntncncaataccagttcactggtattaaaaaatatttcaactcttatactctcacaggtagaatgaactgtgtactggccacatatggaagcattgcattgattgtcttatatttcaagttaaggtccaaaaaaactccagctgtgaaagcaacataaatggattttaaactgtctacggttcttaacctcatctgttaagttcccatgcctggagaagctaatgccaactcatcatgtgataattcaatttgtacaataaattatgaacctcg

SEQ ID NO: 58274 - DNA, 124 bp, Homo sapiens
  misc_feature 7: n = A,T,C or G
cccgagngattttgcgaaacccccttttcccttcagcttgcttagatgttccaaatttagaaagcttaaggcggcctacagaaaaaggaaaaaaggccacaaaagttccctctcactttcagtg

SEQ ID NO: 58275 - DNA, 198 bp, Homo sapiens
  misc_feature 4, 7: n = A,T,C or G
ggcncgncagaaatgctattcttgaagtggaaatataggttatgaaatcatttttaaaaaattttattaaacatatgtatatatctaaacatatatatatggtatatcctatgtgctaggcactattgtgctttacaaatcatttaattatcataacccaattatgaagtagatatactattattccatattcagcga

SEQ ID NO: 58276 - DNA, 106 bp, Homo sapiens
agttttgtctctgacttttagaaataaatttcagaaaaattgtttcaaaagattttgaaagcacattttgttttgtgagtcaatgacaaatatatttcctgattac

SEQ ID NO: 58277 - DNA, 311 bp, Homo sapiens
tatggccggggaggccctgaggcagccagcgcaggggctttttgctgagggggcaggcggagcttgaggaaaccgcagataagttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtattt

SEQ ID NO: 58278 - DNA, 357 bp, Homo sapiens
  misc_feature 5, 27, 122: n = A,T,C or G
atggnccggggccttcccggcggtgangacctacgcacactagaaacatgcctctcgcaaaggatctccttcatccctctccaggaagaggagaagaggaaacacaagaagaaacgcctggngcagagccccaattcctacttcatggatgtgaaatgcccaggatgctataaaatcaccacggtctttagccatgcacaaacggtagttttgtgtgttggctgctccactgtcctctgccagcctacaggaggaaaagcaaggcttacagaaggatgttccttcaggaggaagcagcactaaaagcactctgagtcaagatgagtgggaaaccatctcaataaacacattttgggt

SEQ ID NO: 58279 - DNA, 500 bp, Homo sapiens
  misc_feature 15, 24, 53, 60, 90, 94: n = A,T,C or G
actctacttcaaggnggcggctgncccttaacatatataccatgggattcttnaatgggnattattacaattgacccttgagcaacacangggntagggaccaccctctccttccccatgcttttgactgcccaaaaaacgtagctgctaatagcccactgatgactggaagtttactgatagcatatattgttgactaacgtattttgtatgtcatatgtgttatatactgtattcttacaataaagtaagttagagaaaaaaagttactaagaaaatcataaggaaaagtaagtatatttactaatcattaagtggaaatggatcatcataaagatcttcgtccttgtcaccttcacattgagtagactgaagaggagctgagtggataaagaaaatgtttatgtacatcgtggaatactattcatccatacaaaggaacgaaataatatcttttgcagcaatttggatggagctggaggccagtattctaagtgaag

SEQ ID NO: 58280 - DNA, 191 bp, Homo sapiens
  misc_feature 3, 4, 31, 35: n = A,T,C or G
tanncagtaaggagtaaagctcgagtcatcntttnaggaagagaagaatttcaaagccttcgctagtctccgtatggcccgtgccaacgcccggctcttcggcatacgggcaaaaagagccaaggaagccgcagaacaggatgttgaaaagaaaaaataaagccctcctggggacttggaatcagtcggcg

SEQ ID NO: 58281 - DNA, 208 bp, Homo sapiens
  misc_feature 99, 117, 119, 150, 155, 182, 192, 208: n = A,T,C or G
tgcagtgagccgattgcaccactgcactccagcctaggtgacagagcaagactccctctcaaaaaaaaaaagaaaaagaaaaagaaaaaaagaaagccntcttgagttgaaaatgcngngagaagattgaaagataacagaatgacaagngtttntaaatggagttgagtgagttgctgagngtattcgttnggctagtttctctctn

SEQ ID NO: 58282 - DNA, 189 bp, Homo sapiens
  misc_feature 127, 129, 175: n = A,T,C or G
tcagaaaaagaaagaagccaaagagaaaggtacctgggttcaactaaagcgccagcctgctccacccagagaagcacactttgtgagaaccaatgggaaggagcctgagctgctggaacctattccntntgaattcatggcataataggtgttaaaaaaaaaaataaaggacctntgggctgaaaaaag

SEQ ID NO: 58283 - DNA, 499 bp, Homo sapiens
aatttggattgatttatgcactgcctatctgttttgacacagatttccttgtaaaatgtgcctagtttaccaaaattaacaaagggggggaaaggaccttagaactttttaaggtaaaatcaaatatagctacagcataagagaatcgagaaatttgatagaggtaacttgtttaatgtaaatctaatagtacttgtaatttctttctgcttagaatctaaagatgtgtttagaacctcttgtttaaaaataatagactgcttatcataaaatcacatctcacacatttgaggcagtggtcaaacaggtaaagcctatgatgtgtgtcattttaaagtgtcggaatttagcctctgaataccttctccattgggggaaagatattcttggaaccactcatgacatatcttagaaggtcattgacaatgtataaactaattgttggcttgatatttatgtaaatatcagtttaccatgctttaattttgcacattcgtac

SEQ ID NO: 58284 - DNA, 255 bp, Homo sapiens
atggaccggggaaggggcaggctagggagtggtcggcccagttatttattttatcactgacattactaagaattgtcaggacagagtaataatcaaaagcaagccagcttttagtggggcttttttattgtttttaggccattgcctgcacactcccacagcattccccattcttgaaacttgactatagctactgacgctcctggaaagaaggaggaacagaagacatctcagctgaagcatggagtatatttt

SEQ ID NO: 58285 - DNA, 460 bp, Homo sapiens
  misc_feature 6, 32, 33: n = A,T,C or G
gggganccaaagtgaagctacatagctaacannttcttattcatttagtaagttggctgccctctgctgttcataatgtttcttaaacagattcgtttcctctaagagaagtttctatctccccttggcaaaacaaaatactattcttgaaaacagaagttataataattaatgatatcattcagtgtgtaacattagaaactatgaagtttaaaagagtcagaggttagttttcctgtagaaggaatagtatgtctctctaaacagaagagaaattactggaaattctctctcctgtcagttaccctaaaaaccagctccagcaaagccatttcacgaacaattatgcatctataatgatctaaataataattggagaaaaatagtattttatggacattaaaatctcaattaatactattgcaactattgaatcaaatataaattgaattaaattttt

SEQ ID NO: 58286 - DNA, 365 bp, Homo sapiens
  misc_feature 44: n = A,T,C or G
tatggccggggttttgcaaaaatcagtaagtagggcatttgttnaaatagatgaaggagaacaacatgccaggcaaggaaaatggcataaagaaaagcacaaacgcttagcataaaacaagtcgtcttttagagccaagtcttgtccaaactgatgaaactttcctttggaatacatgtataaaatagattggattctccttactgtagaaggtctcatgtttacattttatcgctatgaaaattggccaggcgtggtggctcacgcttgtaatcctagcactttgggaggctgaggcggtgggtcaccctgaggtcaggagttcaagaccagcctgtccaacatggtgaaaccctatctctact

SEQ ID NO: 58287 - DNA, 482 bp, Homo sapiens
gtttggcaagagaccaaaactctgtctcaaaaaaaaacaaaacatagttcacacttaaatattttattccatatctttacatacccaatatgttaatttatagttcaagatgaacttgtttgggacagattttgtaataaaggaaatcgtgttattagaaatatctagaggccatgagcccttaaactgttctaatttgcaagtagttccctgtgtgatgcagtttttttcaatattgcacaataaaggcaaaatacggacaaattagatgataagatttatataaatttttaaaatattgatcaaaatatgtatccatattggtaatatttgtatttataataaatcattgctgtaaatttgaacttagaaaaattttactaataaaggtgcttttgtgttgcaaactttcatttgaaaagtaatttttctttgtaccaaaaaatctaaaattcgctattctagtcaccaaaatttgcttt

SEQ ID NO: 58288 - DNA, 485 bp, Homo sapiens
  misc_feature 7, 31, 32, 58, 59: n = A,T,C or G
gaaggcngagcttgatcagcaaaataaaagnnttgattgtttaaagggtgaaatggannacgacaagagcaagatggagaaaaaggagtctaatttagaaacagagttaaagtctcaaacagcaagaattatggaattagaggaccatattacccagaaaactattgaaatagagtccttaaatgaagttcttaaaaattacaatcaacaaaaggatattgaacacaaagaattggttcagaaacttcaacattttcaagagttaggagaagaaaaggacaacagggttaaagaagctgaagaaaaaatcttaacacttgaaaaccaagtttattccatgaaagctgaacttgaaactaagaagaaagaattagaacatgtgaatttaagtgtgaaaagcaaagaggaggagttaaaggcattggaagataggcttgagtcagaaagtgctgcaaaattagcagagttgaagagaaaagctgaac

SEQ ID NO: 58289 - DNA, 496 bp, Homo sapiens
  misc_feature 27: n = A,T,C or G
agcggggtgttcctggttctctgaccngcaccatggttttttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctctt

SEQ ID NO: 58290 - DNA, 487 bp, Homo sapiens
  misc_feature 7: n = A,T,C or G
gatagangatatggtttacattaccgtttgttttcattgtgattgcccctatgtaacaatcatgaatattagattttttaaattgtagaatatcctaatatttatagccagcagctgttactttgtttgtaaaatttgcaaaaaaacaaaacctgaagttggtttattgaaagaattataaggatagcttctagggatattagtaatagattgccatgatcctgaagcctcttctcagaacactgtgaagataatactgacagagtagaatcagtgaaaacagcctaacaaaacctctgacatcagtatatcaacttttaacagcccactcactggcttttctaaactaccaaaaaccacctgtaggatactgcattaagtcagcatctcagaaacagtggtgtgagtaactgagtcaaattgtcaagtactttggatatacataggtgtcgagctttagattggtatgaaattaaacagcaatgca

SEQ ID NO: 58291 - DNA, 460 bp, Homo sapiens
  misc_feature 300, 380, 392, 442: n = A,T,C or G
ggaaggccgtgcaaaaactaacattgaaattttgaaacagcagcagagtgagtggattttatttttcgttattgttggtggtttaaaaaattccccccatgtaattattgtgaacaccttgctttgtggtcactgtaacatttggggggtgggacagggaggaaaagtaacaatagtccacatgtccctggcatctgttcagagcagtgtgcagaatgtaatgctcttttgtaagaaacgttttatgatttttaaaataaatttagtgaacctatttttggtggtcattttttttttaanacagtcattttaaaatgggggctgaatttcccaacccacccccaaactaaacactaagtttaattttcagctcctctgtnggacatataagngcatctcttgttggacataggcaaaataacttggcaaacttagttctggngatttcttgatggtttgg

SEQ ID NO: 58292 - DNA, 470 bp, Homo sapiens
  misc_feature 2, 7, 34: n = A,T,C or G
gntcttnttccggctggaaccatggagggtgttnaagagaagaagagggaggttcctgctgtgccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagaactgaaattcgaatggcgaggatggcaagaaaagctggcaacttctatgtacctgcagaacccaaattggcgtttgtcatcagaatcagaggtatcaatggagtgagcccaaaggttcgaaaggtgttgcagcttcttcgccttcgtcaaatcttcaatggaacctttgtgaagctcaacaaggcttcgattaacatgctgaggattgtagagccatatattgcatggggggtaccccaatctgaagtcag

SEQ ID NO: 58293 - DNA, 500 bp, Homo sapiens
  misc_feature 5, 6: n = A,T,C or G
ctcgnntttttatggaccggggaaactcggtggtggccactgcgcagaccttacttcgctcgtactcgtgcgcctcgctttgcttttcctccgcaaccatgtctgacaaacccgatatggctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggcagggaaggaaagaacttgcatgttggtgaaggaagaagtggggtggaagaagtggggtgggacgacagt

SEQ ID NO: 58294 - DNA, 500 bp, Homo sapiens
  misc_feature 8, 12, 44, 47, 73: n = A,T,C or G
gatggganaggnattaccccactttgcaaatccttcgtggaacnttntgtatatttgtggaaccaatctttgnggaacatattccagctttttgaatgagtgcatatccagtagtacctttaaagtaacactttgtacataacaaatactcagcaaatgtgaaactttatttgctcttacttcaaaattagtccaaaatgttggaaataaaatataagacattgatctagacatgaggtttttctccttcattctcagctgtcgaagaaatcaaagtagcatatgcacaaggttaaaaaccacatatacaaatactatagaacagcttataatgaaaaccttgcctgcctttataaaaaatgtgattatcttcttctgttaatgtcaataaaagatggtttgtcctagaaggtctataaatggtattatgttctggaggaaacctagcaaaaactttgctagtttagtacttgtctctaaattgatgttcacccatttca

SEQ ID NO: 58295 - DNA, 217 bp, Homo sapiens
  misc_feature 19, 24, 30, 32, 33, 35, 43, 50, 75, 102, 159, 189: n = A,T,C or G
cttacctggaccgcagggnccccncgcctncnnanggaccggnggctccnctaaaaacatactgtattctgttgntgtgtgtgttcattttaaattgagccntaagggaatgccgcatttaaatcagaactctgccaatgcttttatctagaggcgtgntgccatttttgtcttatatgaaatttctgncccaagaaaggcaggattacatcttttt

SEQ ID NO: 58296 - DNA, 210 bp, Homo sapiens
caagaccagcctgggcaacagggtgaaaccctgtctctacaaaacatacgaatattagctgggcatggggggtgtccacctgtagtcccagctacatgggaggctgggatggaagaatcacctgagcctgggaggttgaggctgcagtaagcagtaagccatatgccaccactgtactctagtctgagcaagagtgacatcctgtcttac

SEQ ID NO: 58297 - DNA, 459 bp, Homo sapiens
  misc_feature 5, 29, 30: n = A,T,C or G
gggancgagaaaatactggatcaggcctnntaaggtaatctaggatcttgttcaaagtgtggtccatagcaacatcagtttcacttgggagttactgagaaaggcagaatctctgcagacctactgaacgaggatctgcattgtaaaccatttatcaaggctgggcatggtggctcacacatgtaatcccagcattttgggagcctgaggcaagaggatacttgagaccaggatttcgagaccagcctgggctacacggtgagaccccatctctacaacaaattaaaaaattagccaggcatgctggctcatgcctgtggtgccagcctaggaggatcccttgagcctaggaggttgtggtaccaggtaggaggatcccttaagcccaggagattgaggctgcagtgagcccacattgcatcactgcactccagtctgggtgacagagcaagaccctgt

SEQ ID NO: 58298 - DNA, 263 bp, Homo sapiens
  misc_feature 25: n = A,T,C or G
catgttttctatttcaattatattnaattttgagacatataagtcagtgatcatttatgattattgaatgtcctgtgatttcataagtaaatctttaaaattttagctttactcaaaataatccaagaccatttactatgacttaaattattcataaagcaaggtgattattactcttgagaccattgtacaaagccctgaagtgtgttacacataggccagaaacctttctcctttgttatatcttatgagtctgttagggt

SEQ ID NO: 58299 - DNA, 487 bp, Homo sapiens
  misc_feature 4, 5, 30, 31, 56, 484: n = A,T,C or G
agcnncagattttaagagaaaatatgaatnnttagaagagtagcatgaggaagganaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacgcatttactaaacgcagacgaaaatggaaagattaattgggagtggtaggatgaaacaatttggagaagatagaagtttgaagtggaaaactggaagacagaagtacgggaaggcgaagaaaagaatngag

SEQ ID NO: 58300 - DNA, 488 bp, Homo sapiens
gtatgacagtctctttatgatgtttgtcttttttgtcatttttgttctttacatcaagcaaattttatgtttaaatatgcggagaatgtatattgcctctgctcctatcagggttgctaaaccctggtacatcgtatataaaatgtattaaaactggggtttgttaccagttgctgtactttgtatatagaatttttataaattgtatgcttcagaaataatttatttttaaaaagaaattaaaagttttaaactcacatccatattacacctttcccccctgaaatgtatagaatccatttgtcatcaggaatcaaaacccacagtccattgtgaagtgtgctatatttagaacagtcttaaaatgtacagtgtattttatagaattgaagttaacattcttattttcaagagaatttatggacgttgtagaaatgtacaaatgcatttccaaactgccttaaacgttgtatttttatagacatgtt

SEQ ID NO: 58301 - DNA, 418 bp, Homo sapiens
tataattacaagtaggtaataatacacaaaggccataattagtctcttctagtgtttagaatgcacttgagaatcgtagagtcatttggagcgtgtttggaccaattagtatgtactgtagtacccttctggcaaacaaataactgaattgctactatttaacaatcttatgagcccacactactgcattttgggagtggcaaatgtgtttggaaatggaagcagttctttttaagcactgtatcagagagattgtcttgtacgtttgcctgttgcaaacaggctggtttgtaaaagatgtatgttttggtgtttgaaatgtttataaaattgtatataaatggtttcaattttccaggcttttgtagatactatatttgatgcctatcaggatgctttaatttggggggtcgaatat

SEQ ID NO: 58302 - DNA, 224 bp, Homo sapiens
tctggccaacatggcgaaaccctatctctgctaaaaacacaaaaagtagccaggcacggtggtggatgcttgtagtcccagctacttgggaggctgaggtgggagaattgcttgaacacgggaggctgaggtgggagaattgcttgaacccgggaggcacaggtttcagtgagctgagatcacaccactgcactccgacctgggtgacggaccgcgactctgtc

SEQ ID NO: 58303 - DNA, 203 bp, Homo sapiens
  misc_feature 33: n = A,T,C or G
aagatggccaagcctgtgtatcgtggagaaacnttagaccaactttttcattccctgcccccaatttcccagactagatttcaagctaattttctttttctgaagcctctaacaaatgatctagttcagaaggaagcaaaatcccttaatctatgtgcaccgttgggaccaatgccttaattaaagaatttaaaaaagttgtg

SEQ ID NO: 58304 - DNA, 475 bp, Homo sapiens
  misc_feature 2, 8: n = A,T,C or G
gnaggccntgaggcagccagcgcaggggcttttgctgagggggcaggcggagcttgaggaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgat

SEQ ID NO: 58305 - DNA, 488 bp, Homo sapiens
  misc_feature 8, 32: n = A,T,C or G
gggggccnttcctgaagctgacagcattcgtntcgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattgatatgcttataca

SEQ ID NO: 58306 - DNA, 158 bp, Homo sapiens
  misc_feature 25: n = A,T,C or G
cctacattaaagatgacactctgtncttgaaagtggccgtggacttaactgacctggaggatctctagtcactgttatggggtgataagaggacttcttggggccagaactgtggaggagagcacatttgattatcatattgacctggatttagactc

SEQ ID NO: 58307 - DNA, 298 bp, Homo sapiens
  misc_feature 1, 3, 263: n = A,T,C or G
nanggccggggataaaccctaactctatgctgaaatcccaacattataaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggngctataataaataaacttcaacactctttatgaga

SEQ ID NO: 58308 - DNA, 345 bp, Homo sapiens
  misc_feature 41, 43: n = A,T,C or G
tatggccgggataatccggaaaaatctggatttctgatgcntnagggttaaagcttcttggatttcatttcattgatatacagccactattttatttttgatcagtggcctttgggccactgttcagggtactgaccatcagtgtcagcattagggttttggtttttgtttcttttgggtctttctttttggcacatgtgaatcttgttttgtgtaaaatgaaattactttctcttgttctctgatgatgggtttaaaattaaaagagcatccggttttggtatggggatgatccaggattatgttgtgactgatacatattagttacttgtgcttttttttttt

SEQ ID NO: 58309 - DNA, 498 bp, Homo sapiens
  misc_feature 25: n = A,T,C or G
aacaaacagacagacagaaaggccntagcacgtccacccagagaccccatctgaaggtcaccatcatcaaaggtcaaaggtagataaatccacgaagatggggagaaaccagcacaaaaaggctgaacattccaaaaaccagcacgcctcttctcctccaaaggatcacaactcctcgccagcaagggaacaaaacaggacagagaatgagtttgataaattgacagatgtcagcttcagaacgtgggtagtaacaaactcctccgagctaaaggaccatgttactaatttaatgcaaggaagctaagtacctggaaaaaaggttagaggaattgctaactagaataagcagtttagagaaaaacataaatgacctgatggagctgaaaaacacagcacaagatcttcgtgaagcatacgcaagtatcaatagccaaatcaatcaagtggaagaacggatgtccgagattgaagatcaactcaatgaaataaagcatg

SEQ ID NO: 58310 - DNA, 352 bp, Homo sapiens
aggaaggcgaaaagtatccccctcattccaactttggacactgggatgtgtgcatgtgtttgttcatgtttgtgtttgagcctgtgctaacaaatcgaatacctgggcatcgagcagctcatacataaccagaggaccgaacagtctttctgtccatcactggtctgggttcagaatgcatagacctcccagcccacgttgcctcacatacaccacattgtggagttctctcggaggcagcattcagtgtgctttcaggcctttgacaaattaaacattcaaaagtaaaaattgctcactgctagggtagggggaaaattacaggggtagataaaacaggctagagcttttg

SEQ ID NO: 58311 - DNA, 477 bp, Homo sapiens
  misc_feature 31, 33: n = A,T,C or G
gactttggacaactcagtaaccctggcttgntncactctcaggagtccatccttgagagagtgggtgtagttaccatttatacagtaatcattgcattttaaaatcttctcttgaaaggaagaataagagtgcaccagaataagagcgcaccagaataagagcacaccagctaacaatgtgatacggccatatgtcacttaaggatggagatatgttctgagaaatgtgtcattaggcgattttgtcattaaacatcatagcatgtacttccacaaacctagatggtatagcctactacacacctaggctatttggtatagcctgttggtcctggggtacaaatctgtacaacatgttactgtattgaatacagtaggcaattgtaacacaatggtaagtatctaaacatagaaaagggacagtaaaaatatggttttataatcttctgggaccaccattgtatatgcggtacatca

SEQ ID NO: 58312 - DNA, 484 bp, Homo sapiens
  misc_feature 16, 17, 41: n = A,T,C or G
tatggccgggagcctnnttgaatgaaatcatctatctctgnttgggcgcaacgaactgcatttctttggacttctgaatccatgtttgtgctttctctggcccgtgaacacctcggcgattctgttagggatgggatgagtgggaggaagccctttgagaagggggagccggccctgtcatgcgcaggttttccactcatctgaggaagagccagggctctgaatttagcctaacactcatcttggctgtgggcttgggaagaaatggccattatttacagattgtatttggtacatattgtgtgatacttgaaaagataaaagggactgccagcccctaactgaaatctgaagctttttatcgcttatttttcctcgccctgtctcctcccttccacctttctccttgcattgtgatgatctagtaggcacgtctgtcaacaggacacacgcctcctctgactataacctcttaatagttgtg

SEQ ID NO: 58313 - DNA, 500 bp, Homo sapiens
  misc_feature 18, 24: n = A,T,C or G
ctgctcgggttagatcgncagganaagcctaaagattagactgtaagaaaagaaaatagaagccatgtttcgaagacctgtattacaggtacttcgtcagtttgtaagacatgagtccgaaacaactaccagtttggttcttgaaagatccctgaatcgtgtgcacttacttgggcgagtgggtcaggaccctgtcttgagacaggtggaaggaaaaatccagtcacaatattttctctagcaactaatgagatgtggcgatcaggggatagtgaagtttaccaactgggtgatgtcagtcaaaagacaacatggcacagaatatcagtattccggccaggcctcagagacgtggcatatcaatatgtgaaaaaggggtctcgaatttatttggaagggaaaatagactatggtgaatacatggataaaaataatgtgaggcgacaagcaacaacaatcatagctgataatattatatttctgagtgaccagacgaaaga

SEQ ID NO: 58314 - DNA, 478 bp, Homo sapiens
  misc_feature 20, 31, 40, 41, 46, 48, 59, 113: n = A,T,C or G
ggggaacgggcgcagggttngaaacatggcnttcgacgtnnaccancnacaaactaccnacactgtagaggagcccctggatcttatcatggctcagcctagatgagcgaatntatgtgaaaatgagaaatgaccgagagcttcgaggcagattacatgcttatgatcaacatttaaatatgatcttgggagatgtggaagaaactgtgactactatagaaattgatgaagaaacatatgaagagatatataaatcaacgaaacggaatattccaatgctctttgtccggggagatggcgttgtcctggttgcccctccactgagagttggctgaaacaaagaatttgtcctgtatggaaaacgggagactttgtacagtggcctctctaaaagtacaaaacattcataagagaaacctgcatacattttgatattaagaaataattccggggattcttccactcctgaaatgagttg

SEQ ID NO: 58315 - DNA, 473 bp, Homo sapiens
  misc_feature 30, 31, 33: n = A,T,C or G
gagtgccatctgggcgatcgcttcctggtnntngcctcctccgctgtctccctggagttcttgcaagtcggccaggatgtctcaggctgagtttgagaaagctgcagaggaggttaggcaccttaagaccaagccatcggatgaggagatgctgttcatctatggccactacaaacaagcaactgtgggcgacataaatacagaacggcccgggatgttggacttcacgggcaaggccaagtgggatgcctggaatgagctgaaagggacttccaaggaagatgccatgaaagcttacatcaacaaagtagaagagctaaagaaaaaatacgggatatgagagactggatttggttactgtgccatgtgtttatcctaaactgagacaatgccttgtttttttctaataccgtggatggtgggaattcgggaaaataaccagttaaaccagctactcaaggctgctcaccata

SEQ ID NO: 58316 - DNA, 425 bp, Homo sapiens
  misc_feature 29: n = A,T,C or G
caagccgtagctttcccatttgtcacatntatcagaggagagatggtgttgggagccctttggagaacgccagtctcccaggccccctgcatctatcgagtttgcaatgtcacaacctctctgatcttgtgctcagcatgattctttaatagaagttttattttttcgtgcactctgctaatcatgtgggtgagccagtggaacagcgggagacctgtgctagttttacagattgcctcctaatgacgcggctcaaaaggaaaccaagtggtcaggagttgtttctgacccactgatctctactaccacaaggaaaatagtttaggagaaaccagcttttactgtttttgaaaaattacagcttcaccctgtcaagttaacaaggaatgcctgtgccaataaaaggtttctccaacttgaagtct

SEQ ID NO: 58317 - DNA, 457 bp, Homo sapiens
  misc_feature 5, 12, 32, 53: n = A,T,C or G
aactncgggctnttatggcccggggaagttcncagacgcatgccctgcagatngcctcttttgctacagtaaagtatactaaaaggatcacaactgtcacaaccttccggaaggagtagctgacctgacacagattgatgtcaatgtccaggatcatttctgggatgggaagggatgtgagatgatctgttactgcaacttcagcgaattgctctgctgcccaaaagacgttttctttggaccaaagatctctttcgtgattccttgcaacaatcaatgagaatcttcatgtattctggagaacaccattcctgatttcccacaaactgcactacatcagtataactgcatttctagtttctatatagtgcaatagagcatagattctataaattcttacttgtctaagacaagtaaatctgtgttaaacaagtagtaataaaagttaattcaatct

SEQ ID NO: 58318 - DNA, 499 bp, Homo sapiens
  misc_feature 3: n = A,T,C or G
aangagccagagaaaccgatcgaccgcgagaagacatgcccactgttgctacgggtcttcaccaccaataacggccgccaccaccgaatggacgagttctcccggggaaatgtaccgtccagcgagttgcagatctacacttggatggatgcaaccttgaaagaactgacaagcttagtaaaagaagtctacccagaagctagaaagaagggcactcacttcaattttgcaatcgtttttacagatgttaaaagacctggctatcgagttaaggagattggcagcaccatgtctggcagaaaggggactgatgattccatgaccctgcagtcgcagaagttccagataggagattacttggacatagcaattacccctccaaatcgggcaccacctccttcagggcgcatgagaccatattaaattctatttactatttgttgaatttatttttccgtcagttatgtaaaataaacatactcttcctcctcccctgatt

SEQ ID NO: 58319 - DNA, 456 bp, Homo sapiens
  misc_feature 15: n = A,T,C or G
caattcctgatgatnaaaaggtctcagatgattataaagaaaagggagagggagctcttccaactgggaaatccaaaaagaaaaaaaagaaaaagaagaagcaaggtgaagataactctactgcacaggacacagaagaattagaaaaagagattagagaagaccttccagtgaatacctctaaaacccgtccaaaacaggaaaaagctttttccttgaagaccataagcactagtgatccagccgaagtactcgtcaaaaatagccagcctatcaagactcttccacctgctacttctaccgagccatctgtaatcttatcaaaaagtgattctggcaagagctcttcccaagtgccgccaatactacaagagacagataaatccaagtcaaataccaagcaaaatagtgtgcctccttcacagaccaagtctgaaactagctgggaatctccca

SEQ ID NO: 58320 - DNA, 239 bp, Homo sapiens
cccacaggccgaggagtcagcaactgtctcagcccctgcacccatgagccccacaagaagacgagccctggaccattatctcacccttcgaagctctggatggatcccagatggacgaggtcgatgggtaaaagatgaaaatgttgagtttgactctgatgaggaggaaccacctgatttccccttggactgatacccttttcccattcattcacaaataaattacaatgggtgctgac

SEQ ID NO: 58321 - DNA, 497 bp, Homo sapiens
aatatcgccccactccgcgcccgggacgatttcttcccgggttccgatcgctttgcccggccggacttcagggacatttccaaatggaacaaccgcgtagtgagcaacctgctctattaccagaccaactacctggtggtggctgccatgatgatttccattgtggggtttctgagtcccttcaacatgatcctgggaggaatcgtggtggtgctggtgttcacagggtttgtgtgggcagcccacaataaagacgtccttcgccggatgaagaagcgctaccccacgacgttcgttatggtggtcatgttggcgagctatttccttatctccatgtttggaggagtcatggtctttgtgtttggcattacttttcctttgctgttgatgtttatccatgcatcgttgagacttcggaacctcaagaacaaactggagaataaaatggaaggaataggtttgaagaggacaccgatgggcattgtcctggatgccct

SEQ ID NO: 58322 - DNA, 498 bp, Homo sapiens
  misc_feature 2, 8, 28, 52: n = A,T,C or G
cnatgagnacgtatcttcataccctttngaaaaagataactttggaagctantgaaggcttagcttcttgaatggtctgtactatatatgaaagcaagaacaattaaaaagtctttaaattgttcaattttctataattccaatgctcctaagaagctcccctccccgctgccattatggggctcttacctaactcaatataccaaaaatactatcctatttctttatctgtggttctttgtttatcttttttggaaaatgttttatcaaaatttataatttctaatgatgctgtattggcataaccacttgaaaaaataagagaaatagtcctagaataggaaacttgtgatatatatgactctctggagaactaaagtaaaaattaaactaaaaagtgaacttattttaattatgttattaaaaacacagtaggcggatgtaagaaaacaagctatttggttatatttatttcagaaaaaaggtcagtgacccatt

SEQ ID NO: 58323 - DNA, 499 bp, Homo sapiens
agaaacacgtttggtttggagagtccatggatggtggttttcagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcgaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaat

SEQ ID NO: 58324 - DNA, 499 bp, Homo sapiens
  misc_feature 24: n = A,T,C or G
gtacggtcctgctagtagaggaanatgtcgagtttctctagggcgccccagcaatgggccacttttgctagaatatggtatctcttagatgggaaaatgcagccacctggcaaacttgctgctatggcatctataagacttcagggattacataaacctgtgtaccatgcactgagtgactgtggggatcatgttgttataatgaacacaagacacatcgcattttctggaaacaaatgggaacaaaaagtatactcttcgcatactggctacccaggtggatttagacaagtaacagctgctcagcttcacctgagggatccagtggcaattgtaaaactagctatttatggcatgctgccaaaaaaccttcacagaagaacaatgatggaaaggttgcatctttttccagatgagtatattccagaagatattcttaagaatttagtagaggagcttcctcaaccacgaaaaatacctaaacgtctagatgagtaca

SEQ ID NO: 58325 - DNA, 490 bp, Homo sapiens
  misc_feature 26, 27, 28: n = A,T,C or G
ggacacctcggtggtggccctgcgcnnnttttacttcgctcgtactcgtgcgcctcgctttgcttttcctccgcaaccatgtctgacaaacccgatatggctgagatcgagaaattcgataagtcgaaactgaagaagacagagacgcaagagaaaaatccattgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgcctgcctttcccatctgtctatctatctggctggcagggaaggaaagaacttgcatgttggtgaaggaagaagtggggtggaagaagtggggtgggacgacagtgaaatctaga

SEQ ID NO: 58326 - DNA, 279 bp, Homo sapiens
cttacagtaagaaataaaactaaaaaattagtaggaaatacatatgagaaaaacttcgtgacattggatttagcagtgatttctaggctatgacactaaaaacaagtaacaaaaaatagataaattggactacatcaaaatggaaaacttgtgtgcatcacaagacactatcaacagagtggagggcaaccaatggaatgagagaaaacatttgtaaatcatatatctgataagaggttaatattcataatgtataatgaactcctacaactcaacagt

SEQ ID NO: 58327 - DNA, 310 bp, Homo sapiens
  misc_feature 6, 7, 23, 25, 32, 309: n = A,T,C or G
tagctnngtcttgatgcaaaagnanaatttanttttaaattctttttatttaaataaagatcattctattcttacattttcttttattagtcaatctgttcaaatgactgactttttattttattagtcaatttttaaaaaatcttccatttcaaaatatttgtctcctaaagcttatagaaaaaggcaggccaggcatagtagctcatgcctataatcccagcactttgggagcccaaggtaggaggattacttaagcccaagaattcgagaccagcctaggcaacatagtgaaacagtatctctacng

SEQ ID NO: 58328 - DNA, 498 bp, Homo sapiens
  misc_feature 17, 22, 436, 459, 460: n = A,T,C or G
gagggggcaggcggagnttgangaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggngattaaaagaccttgaaatccanngacgcagggagaattgcgtcatttaaagcctagttaac

SEQ ID NO: 58329 - DNA, 234 bp, Homo sapiens
aatgattgcattgactaccaaggaaaacaattcaggaatgaatagcatggaaacagttttattcactccttcaaaagcccccaaaccagtgaatgcatgggcatcttctctgcattcagtttcatccaagtcattccgggatttcttactagaagaaaaaaagtctgttactagccatagttcaggcgatcatgtcaaaaaagtttcttttaaaggaattgaaaattctcaggc

SEQ ID NO: 58330 - DNA, 500 bp, Homo sapiens
tactgatctggagaaggacattatttcggacacatctggtgacttccgcaagctgatggttgccctggcaaagggtagaagagcagaggatggctctgtcattgattatgaactgattgaccaagatgctcgggatctctatgacgctggagtgaagaggaaaggaactgatgttcccaagtggatcagcatcatgaccgagcggagcgtgccccacctccagaaagtatttgataggtacaagagttacagcccttatgacatgttggaaagcatcaggaaagaggttaaaggagacctggaaaatgctttcctgaacctggttcagtgcattcagaacaagcccctgtattttgctgatcggctgtatgactccatgaagggcaaggggacgcgagataaggtcctgatcagaatcatggtctcccgcagtgaagtggacatgttgaaaattaggtctgaattcaagagaaagtacggcaagtccctgtactattata

SEQ ID NO: 58331 - DNA, 297 bp, Homo sapiens
  misc_feature 30: n = A,T,C or G
aaggtcgactcggtgtgaggctgcagtggntgggggatggatcctccccacacatctgaggacacacaaccacttggtacattttctcagatgttaagcttatttttataaaccacattgtacgtgtcacttttatttggcattttatacttaactagttgtatttatttttcatgtcatgggagttttcatataatgtgccataactgcatagacagcacgtcttcagggtgtggtttctaagcagaaaatagcaaatgtttatattgaataaaattgcatgttcctccacgcagc

SEQ ID NO: 58332 - DNA, 455 bp, Homo sapiens
cccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgcttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatg

SEQ ID NO: 58333 - DNA, 280 bp, Homo sapiens
  misc_feature 152: n = A,T,C or G
aggccttcgataggcactgcaacctggtgctggagaacgtgaaggagatgtggactgaggtacccaagagtggcaagggcaagaagaagtccaagccagtcaacaaagaccgctacatctccaagatgttcctgcgcggggactcagtcatngtggtcctacggaacccgctcatcgccggcaagtaggggccgcctgtctgttgacagaactcactcctctgtcctatgaagaccgctgccattggtgttgagaataataaagctctgtgtttttttct

SEQ ID NO: 58334 - DNA, 428 bp, Homo sapiens
  misc_feature 31, 39: n = A,T,C or G
gcttttcctccgcaaccatgtctgacaaacncgatatgnctgagatcgagaaattcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgccctgcctttcccatctgtctatctatctggctggcagggaaggaaagaacttgcatgttggtgaaggaagaagtggggtggaagaagtggggtgggacgacagtgaaatctaga

SEQ ID NO: 58335 - DNA, 444 bp, Homo sapiens
  misc_feature 13, 16, 48, 378, 426, 434: n = A,T,C or G
cacagcctggggnttnggtcattgttctcctcgtccatcagggatctnagaggctcagagactgcaagctgcttgcccaagtcacacagctagtgaagaccagagcagtttcatctggttgtgactctaagctcagtgctctctccactaccccacaccagccttggtgccaccaaaagtgctccccaaaaggaaggagaatgggatttttcttttgaggcatgcacatctggaattaaggtcaaactaattctcacatccctctaaactactggtaggaacagcagtgtctcacagtgtggggcagccgtccttctaatgaagacaatgatattgacactgccctctttggcaggtgcattagtaactttgaaaggnatatgactgagcgtagcatacagggtaacctgcagaaacagtacttangtaattgnaagggcgagg

SEQ ID NO: 58336 - DNA, 200 bp, Homo sapiens
  misc_feature 44, 195: n = A,T,C or G
tctaaggctgatgaagctgtagctgtactacaagcccaccaagntttagaggctgcccagaaagcagttaacagtgccaccggtgttccaactgtttaaaattgatcagggaccatgaaaagaaacttgtgcttcaccgaagaaaaatatctaaacatcgaaaaacttaaatattatggaaaaaaaacattgccngtttt

SEQ ID NO: 58337 - DNA, 336 bp, Homo sapiens
  misc_feature 6, 15, 29, 41, 45, 53, 64, 120, 134, 139, 275: n = A,T,C or G
gtgtcnggtatcgcnctggacagggcatnttgagagttgcngggnttcatttntctaaaaatangaagtgagatgccactaaatgccagatgctatattaagtgctaactacagtcttgntgaacaaaaaggtnaaatnttcctgctctcgtggggcctgcattcttatggaggagatggaatatattttttaaaacataaaatctaaatttattttgaggtgattttgatcagccctcaaagaagcaagagggtgaacagcagtaatatctganggacaagcattctaattatagggacagcatatttaaaagccctggctcgttcagtgtattt

SEQ ID NO: 58338 - DNA, 112 bp, Homo sapiens
atgaaattataaataacaaaaggaaatgttgggaattcacagatagttggaaattatacaatatacttctaaataaccaaagaatcaaagaagatacttcaaaggagagtag

SEQ ID NO: 58339 - DNA, 472 bp, Homo sapiens
  misc_feature 7, 48, 450, 466, 470: n = A,T,C or G
cgaaganaattgttacaagaagacacacccgtgaggaagttgcaagcntcaaaaaagttcaaggatctagaagacgattaagggaaggtcgttctcagtgaaaatccaaaaaccagaaaaaaatgtttatacaaccctaagtcaataacctgaccttagaaaattgtgagagccaagttgacttcaggaactgaaacatcagcacaaagaagcaatcatcaaataattctgaacacaaatttaatatttttttttctgaatgagaaacatgagggaaattgtggagttagcctcctgtggtaaaggaattgaagaaaatataacaccttacaccctttttcatcttgacattaaaaggtctggctaactttggaatccattagagaaaaatccttgtcaccagattcattacaattcaaatcgaagagttgtgaactgttatcccattgnaaagccgagccttgtntgtntg

SEQ ID NO: 58340 - DNA, 391 bp, Homo sapiens
  misc_feature 11, 19, 50: n = A,T,C or G
aacccctcatntgggccanccctaaaggccaacccttttggaggcgcttntcatgcaaaaggaatcgtgctggaaaaagtaggagttgaagccaaacagccaaattctgccattaggaagtgtgtaagggtccagctgatcaagaatggcaagaaaatcacagcctttgtacccaatgacggttgcttgaactttattgaggaaaatgatgaagttctggttgctggatttggtcgcaaaggtcatgctgttggtgatattcctggagtcccgctttaaggttgcaaaatagccaatgtttctcttttggccctatacaaaggcaagaaggaaagaccaagatcataaatattagtggtgaaaacactgtagtaataaattttcatatgcc

SEQ ID NO: 58341 - DNA, 212 bp, Homo sapiens
ccacattaggcttaaaaacagaatgcaattcccggacgtctaaaccaaaccactttcaccgctacacgaccgggggtatactacggtcaatgctctgaaatctgtggagcaaaccacagtttcgtgcccatcgtcctagaattaattcccctaaaaatctttgaaatagggcccgtatttaccctatagcaccccctctaccccctctagag

SEQ ID NO: 58342 - DNA, 305 bp, Homo sapiens
  misc_feature 8, 33: n = A,T,C or G
gggggccngcaagcacaactggctttggcattntttatgattccctggattatgcaaagcaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaaagtgagctggagattggatcacagccgaaggagtaaaggtgctgcaatgatgttagctgtggccactgtggatttttcgcaagaacattaataaactaaaaactgt

SEQ ID NO: 58343 - DNA, 256 bp, Homo sapiens
  misc_feature 25: n = A,T,C or G
aaagcctcaggggaagcagctacanacccgagcggattacttgttgaagctgctcagaaagggtctggagaagaagggggctgtgacaggtggggaagaggccaaattaaagaagcggaagcctcgggtaaagaaggaaaacaaagtgcccaggctgaaagaggagcatggaattgagctttcatctcctaggcattcagataatccatcagaagagggagaagtgaaagatgatggcttggaaaaaagtccaatg

SEQ ID NO: 58344 - DNA, 474 bp, Homo sapiens
  misc_feature 2, 43, 461, 467: n = A,T,C or G
tntggccgggattaaccattattctcttgtaaaagaaaagttnaaattagtaaagaaaaaagttttagcctgatgttacctgcttgtgagtatcaattacttagtttttaaatttttaaggtattgcctacttttctttagaatgcagaaatctcgtcctgagcccttattatgcctgtggtagagcaatgcaagactgaaaaggttgccagtattttcaggcttatttgactaagaattagtgccaagaactggaaagtctactttttggagggaaatgatacttagaatttgtaaacataagcagtaatagtgtaaatatttagaaaaatagcaagtgctttaactgctcaataaaatagtatagatgttatttcacccttaaggcactggctgttgcccattattttccgatttcgtgattactgtatatattacattttgagtaatgaataattggnaatagnggattat

SEQ ID NO: 58345 - DNA, 477 bp, Homo sapiens
  misc_feature 30, 58: n = A,T,C or G
gaaacccgtgagaatgaagaggatactttntttttttgttgaaaatagtggccaaagngagtcattaagtggagacacaggaagtctgtcatgtgacaatgcattgtttgtaattgacacaactcctggaatgagtgctgataaaaatttttacttggaagaggaagacaaggcaagtgaggttgccattgaggaagaaaaagaagaggaagaggatgaaaaaagtgaagaagattcatcagaccatgacgaaaatgaagatgagtttagtgatgaagaagacttcctaaatagcacaaaggctaaacttctgaagttgacaagcagcagcatagaccctggtctgagtatcaagcagttgggtggtttgtatattaattttaatgcagataaactacagtctaacaagagaaccctaacacagatcaaggagaaaaagaaaaatgagcttctacagaaagccgtcattacacctga

SEQ ID NO: 58346 - DNA, 411 bp, Homo sapiens
  misc_feature 8, 31: n = A,T,C or G
gatgcccnaacaacaggacttatacctgctntttatgtcaaaattcttggcaaaagaaaaggtaggaaaacggtggaatcaagtaaagtttccaagcagcaacaatcttttaccaacccaacactaactaaaggagccacggttgctgattctttggatgaacaggaagctgcctttgaatctgtttttgttgaaactaataaggttccagttgcacctgattccattgggaaagatggagaaaagcaagatctttgatatctttcatgtttgcctgcagttgaacaatactttagagtactttttaaaattatttctcacaaagaaatgaatgtacaatccaatgaaaacatttgttattggctatttcaggtgttttgctgctagaaattattaaagttacacactagt

SEQ ID NO: 58347 - DNA, 464 bp, Homo sapiens
  misc_feature 89, 167, 403: n = A,T,C or G
ggaccccccatttcttagcatgagctaccttttttctagaagctgggatggacttactattcttgtttatattttagatactgaaaggngctatgcttctgttattattccaagactggagataggcggggctaaaaaggtattattatttttcctttaatgatggngctaaaattcttcctataaaattccttaaaaataaagatggtttaatcactaccattgtgaaaacataactgttagacttcccgtttctgaaagaaagagcatcgttccaatgcttgttcactgttcctctgtcatactgtatctggaatgctttgtaatacttgcatgcttcttagaccagaacatgtaggtccccttgtgtctcgatactttttttttcttaattgcatttgtnggctctattttaaatttttttcttttaaaataaacagctgggaccatcccaaaagacaagc

SEQ ID NO: 58348 - DNA, 180 bp, Homo sapiens
  misc_feature 177: n = A,T,C or G
gcttccacggacttcacgtaattattggctcaactttcctcactatctgcttcatccgccaactaatatttcactttacatccaaacatcactttggcttcgaagccgccgcctgatactggcattttgtagatgtggtttgactatttctgtatgtctccatctattgatgagggnctg

SEQ ID NO: 58349 - DNA, 117 bp, Homo sapiens
  misc_feature 44: n = A,T,C or G
caaggggctcagaagcccagcaatcccttcctttcactaccttnttttttgggggtagttggaagggactgaaattgtggggggaaggtaggaggcacatcaataaagaggaaacca

SEQ ID NO: 58350 - DNA, 326 bp, Homo sapiens
  misc_feature 2, 12, 27, 29, 30: n = A,T,C or G
tntggggatgcnttttaaaaatgcttntnnagaaaaaaaaattttaaaaagaaagctaatgctagtatatactgcaatgttaggggaatgaacatgttttcctactgcattggggacttctagataggttaatgaaaggccttttattctgttactggacatgaaaactttgtctaatttcttactctattgtacgtttacagtcgcagcactaaaaatggatgacatcaaacatttttaacaaaatgatgtacaaactaaggactatttattgataatgttttgctactcttgcagacaatggctataaactgaattaggcagcg

SEQ ID NO: 58351 - DNA, 215 bp, Homo sapiens
  misc_feature 49, 56, 120: n = A,T,C or G
taaaagaccgttaatgataacaatgcatccgtaaaaccttcagaagggnaaaggangaatgttttgggggaccactttggttttctttttggcggtggtggcaggttttaaagttattangtttttaaaatcaggtacttttttaatgggaaacaacttggccaaaaaatttggtcacaggaatttttgaggacccattaaaaaaggttaaaatg

SEQ ID NO: 58352 - DNA, 328 bp, Homo sapiens
  misc_feature 10, 17, 48: n = A,T,C or G
aacacaaagngaaagangagaggcacccggatatatgttctctaggcnttttagaaaacatggagtttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaagga

SEQ ID NO: 58353 - DNA, 497 bp, Homo sapiens
  misc_feature 11, 398: n = A,T,C or G
aaacccaaatncaaccatatttcacaggagggtgttatgcataaagaatattttgtcaaccagaaagatttgaatggccaagcaaaaatgatcgaaagtgtaactgacaatcaaaaatccacagaggaagtagatatgaaaaatatcaacatggataatgatctggaggttttaacatcttctcccactaggaatttaaatggtgcctacctaacggaagggagcaatggagaagtggacatttccaatggtttcaaaaacctaaatttgaatgctgctcttcatcctgatgaaataaatatagagattctgaatgatagtcatactcctggaacaaaggtgtatgaggttgttaatgaagatccagaaactgctttctgtactcttgcaaacagggnagttttcaatactgatgagtgttcaatccaacattgtttatatcagttcacccgtaatgagaaacttcgagatgcgaataaactgctttgtgaagtatg

SEQ ID NO: 58354 - DNA, 396 bp, Homo sapiens
  misc_feature 4, 218, 271, 322, 349, 388: n = A,T,C or G
taanattaccaattttttaggtaatgcctatctcttggtctattaaggaaagaagctatcagtagagaattcaggatagttttgtttaaattcttgcagattacatgtttttacagtggcctgctattgaggaaaggtattcttccatacaacttgttttaacctttgagaacattgacagaaattatgcaatggtttgttgagatcggcttgatggngctggttaatcagttgcttccaaagtggcctactcaagagccctaagactggnagaaattaaaaggatttcaaaaactttctatttcttcttaaacctccagcnaactaggattgtgataccatgaatggnttgatgaagaaaggttgacccaatttggtttttggtggngggggggg

SEQ ID NO: 58355 - DNA, 374 bp, Homo sapiens
  misc_feature 4, 5, 47: n = A,T,C or G
tggnnagaatttacattagaggtaagggatgtatacaaaataatgantacatgtacagaataatgagtttacatttgagctataaagggtgcaataaaaggaaatagtgaggaaagttgatagcacaccatggaaagctaggtttagaatagtttactaaaaaaggtatactttagtactaggcaatagggagtcacaacccagattaattagtttaacatgctgagtgcagtgcacacacctgtaatcccagcactttgggaggcaagatgggaggatcacttgagcccaggagttcaagatcagcctgggaaatatagtaagacctggctctacaaaaaattttaaaaattaagcatggtgtcctgtgtgtg

SEQ ID NO: 58356 - DNA, 228 bp, Homo sapiens
  misc_feature 9, 16, 29, 38, 47, 56: n = A,T,C or G
aactgttcntccaatnggccatttaagtntagtagtanaagactggntaatgatancaatgcatccgtaaaaccttcagaaggaaaggagaatgttttgtggaccactttggttttcttttttgcgtgtggcaagttttaagttattagtttttaaaatcagtactttttaatggaaacaacttgaccaaaaatttgtcacagaattttgagacccattaaaaaagtt

SEQ ID NO: 58357 - DNA, 167 bp, Homo sapiens
  misc_feature 33: n = A,T,C or G
gacttaaacctaagacttcagactatgaaagtnctaaaagaaaacattggggagactctccaggacattgcactgggtagtgatttcttgagtaatacttcgtaaacacaggcaaccaaagctaaaatggacaagtgggatcacattgagttaaaaagctgcacagc

SEQ ID NO: 58358 - DNA, 497 bp, Homo sapiens
  misc_feature 7, 58, 456: n = A,T,C or G
aaagganccctaaagctgaaaacatccctgctgttgtgatagagattaaaaacatgcnaaacaaacaacctgaatcatctttgtgagtcttgaaaaagatgtgatatttgacttttgctttaaactgcaagaggaaaaagactccactgaaattctaagtttgccaagtagtgtaattgaagtccttgtctggtcacacagtttaattctatttttgtaagaacataatgggactgcataacagagttctatattacaattttgtgattattagtacagagtcagctatgctgtgctgttttggaaagccagttttaacactatgttacatttttggttaaagtaaggtaaaccttatataacataatgacatttgatttctggattttcccatgataaaaattagggggataaataaaattggtactggaatttctctgctttcttttccccagngtatactttattagaatataatggtagaccttaaaacatca

SEQ ID NO: 58359 - DNA, 228 bp, Homo sapiens
  misc_feature 5, 56, 129: n = A,T,C or G
aactntcccgtcctgagctcaaatcctgactcaggaactcacaaagctatgtgacnttacaccagtcacttaacttgttagccatccattatcgcatctgcaaaatggggattaagaatagaatcttgnggttaagtgtggagattagattaaatgtatgtaagacacttggcacaaaacctggcacatagtaaaggctcaataaaaacaagtgcctctcataaaaac

SEQ ID NO: 58360 - DNA, 122 bp, Homo sapiens
  misc_feature 47: n = A,T,C or G
taagagactacaaatatggtgcagtatatactgcttgggtagatggntgcaccaaaatctcacaaatcaccactaaagaagttactcatgtagccaaataccacctgtaccccaataatgtt

SEQ ID NO: 58361 - DNA, 455 bp, Homo sapiens
  misc_feature 48, 270, 364, 398, 413, 444: n = A,T,C or G
aagctgacagcattcgggccgagatgtctcgctccgtggccttagctntgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttcnatctcttgtactacactgaattcacccccactgaaaaagatgaagtatgcctgccgggtgaaccacgtgactttgcacagcccaaagataggtnaagtgggatcgagacatgtaacagcatcatgganggttggaagatcccnattttggattggatgaatccaaattctgctngcttgcctttt

SEQ ID NO: 58362 - DNA, 411 bp, Homo sapiens
  misc_feature 3, 4, 28: n = A,T,C or G
ctnncgcaaagaagggtggcgagaaganttagggccgttctgccatcaacgaagtggtaacccgagaatacaccatcaacattcacaagcgcatccatggagtgggcttcaagaagcgtgcacctcggcactcaaagagattcggaaatttgccatgaaggagatgggaactccagatgtgcgcattgacaccaggctcaacaaagctgtctgggccaaaggaataaggaatgtgccataccgaatccgtgtgcggcttgtccagaaaacgtaatgaggatgaagattcaccaaataagctatatactttggttacctatgtacctgttaccactttcaaaaatctacagacagtcaatgtggatgagaactaatcgctgatcgtcagatcaaataaagttataaaattac

SEQ ID NO: 58363 - DNA, 316 bp, Homo sapiens
  misc_feature 6, 9, 32, 35, 41, 52, 58, 61, 68, 70, 79, 95, 179, 259, 293: n = A,T,C or G
aaaganccnatgtaaaagtaaagatgcagganaantgaatngctatggcatncattanttnatgtatntnaagcacagnagtaaaacaaaaaccnatgtatttaacttttttttaggatttttgcttttgtgattttttttttcgatacttgcctaacatgcatggtgctgaaaaaatngttaacaggggaaataacttgagatgatggctagctttgtttaatgtcttatgaaattttcatgaacaatccaagcatanttgttaagaacacgtgtattaaattcatgtaagngggaataaaagttttatgaatgg

SEQ ID NO: 58364 - DNA, 108 bp, Homo sapiens
aacctggaagggacatcttctctggaatagaaccagaggagataaactatcccatggacatttgtattgggccctgaaggaattttcaagcagtgagggctttgcagg

SEQ ID NO: 58365 - DNA, 336 bp, Homo sapiens
  misc_feature 2, 14, 39: n = A,T,C or G
gncatgagcggatntaccagcccagcgaacccagctgtnttcccccatctgaccgtggtgcttttggccattggcatgttcttcaccgcctggttcttcgtttacgaggcacctctaccaagtacactcgtgatatctataaagagctcctcatctccttagtgcctcactcttcatgggctttggagtcctcttcctgctgctctgggttgcatctacgtgtgagcacccaaggtaacaaccagatggctcactgaaacctgcttttgtaaattacttttttttactgttgctggaagtgcccacctgctgctcataataaatgcagatgtatag

SEQ ID NO: 58366 - DNA, 475 bp, Homo sapiens
  misc_feature 5, 7, 411, 470: n = A,T,C or G
attgncncagccagcgcaggggcttctgctgagggggcaggccggagcttgaggattccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggttctaaaacatgacggaggttgagatgaagctcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgnagggtgattaaaataatttggaaggcggatctttttaaaaagagattaaaccggagggngatta

SEQ ID NO: 58367 - DNA, 471 bp, Homo sapiens
  misc_feature 2, 57, 444, 455: n = A,T,C or G
anttaatgcccaaagcgagaagagaaggttagagaaaaaagagtagaaagaaacganctttagcctccaagaaatatgggactatgtgaaaaaaccaaatctacatttgattggtgtacctgaaagtgacggggagaatgggaaccaagttggaaaacactcttagggatattatccaggagaacttccccaacctagcaaggcaggccaatattcaaatttaggaaatacagagaacaccacaaagatactccttgagaagagcaaccgcaagacacataattgtcagattcaccaaggttgaaatgaagggaaaaatgttaaggacagccagagagaaaggtcgggtccccacaaagggaaacccatcagacttaacagcagatctctcggcagaaactctacaagccagaagagagtgggggctggtattcagcattcttnaagaaaagaantttcaacccagaattt

SEQ ID NO: 58368 - DNA, 456 bp, Homo sapiens
  misc_feature 8, 12, 31, 41, 56, 58, 167, 455: n = A,T,C or G
atcgcccngttncgtcttcccggaagcgttngaggacattncctgttgactgcgtngngatgtgtggcgactgtgtggagaaggaatatcccaaccggggtaatacctgcctggagaatggcctttcttactgaactttacaggctgtgcagtgtgcagtaagcggnattttatgctgatcacaaacaaatccttgaaagaagaagatggagaagaaatagttacctatgatcatttgtgtaagaattgcatcatgtaataagccagacatgagtatcattcagtatcatggatgaatttcaggagtatccatgctgtgctgttatgcggcaaagcgaagatactatcaagtattctcctgatgacccccgacaaatgactctcttattctaaggatcctctacagatctgttataactatattgggtgggttacaatacagcaagcctgatggnt

SEQ ID NO: 58369 - DNA, 254 bp, Homo sapiens
  misc_feature 7, 44, 157, 207, 213, 244: n = A,T,C or G
cagaganattgtataagcaaacctaggaaaaccttgtatctatntttttatcatcaaaaagtaattataaatacgtattacaaacaagtggatgtttttaatgaccaattgagtaagaacatccctgtcttaactggcctaaatttcttctgggagngtcagttcaactttcagaagtgccacttaaggaagtttgattttcgtttntgtaangcaccgtttttaatctctctctctttttttntttttttggg

SEQ ID NO: 58370 - DNA, 460 bp, Homo sapiens
  misc_feature 1, 20, 59, 412: n = A,T,C or G
ntaaaatgccataaatagtnctcagagagtagaatcaactgtgattcccgaatctactntaatgagaactctacatagtggagaaataaccagtcatgagcagggcttctctgtggaactggaaagtgaaatttcaaccacagcagatgactgcagttcagaggtaaatggttgcagttttgtaatgagaacaggaaagcctacaaatttattaagggaagaagaatttggtgttgatgattcttattctgaacaaggagcacaagacagtccgctcatctagagatgatggaaagtgagttggctgggaagcagcatgagattgaaagagctaaacagagagctggaagaaatgagggttcctatgggactgaaggactgcagcagttacaagaatttgaagctgccattnaacaaagagatgcattattacccagctcacttgctaattacacaagca

SEQ ID NO: 58371 - DNA, 170 bp, Homo sapiens
  misc_feature 45: n = A,T,C or G
gccagcgcaggggcttctgctgagggggcaggcggagcttgaggntaccgcagataagtttttttctctttgaaagatagagattaatacaactacttaaaaaatatagtcaataggttactaagatattgcttagcgttaagtttttaacgtactcctaatagcttaag

SEQ ID NO: 58372 - DNA, 353 bp, Homo sapiens
  misc_feature 2, 47: n = A,T,C or G
anaacgaaaaatacctaaacgtctagatgagtacacacaagaagaanttgacgccttcccaagattgtggactccacctgaagattatcggctataagagaataagaattgcagaaaataacagtgaagtgattgaaactttcttctgatgagtttctctaacctacaggatggagtaaaacaactgctacagttcagcacctgttttatgtgccgaatcactgtggggaaaggtcaggaaggtgtagccttcaataggaaattgtaattaaaatataattttatagaaccatttttatgtaatctgatttgaatgttatagttgataataataaaatcacttacttgggtga

SEQ ID NO: 58373 - DNA, 459 bp, Homo sapiens
  misc_feature 393, 418: n = A,T,C or G
taaaaagcccaaattaagacaaggcccacagaataagattttccatgcatttgcaaattcgtatattctttttccatccacttgcacaatatcattaccatcactttttcatcattcctcagctactactcacattcatttaatggtttctgtaaacatttttaagacagttgggatgtcacttaacatttttttttgagctaaagtcagggaatcaagccatgcttaatatttaacaatcacttatatgtgtgcgaagagtttgttttgtttgcatgtattggtacaagcagatcagtataaactcacaaacacagatttgaaaataatgcacatatggtgttcaaatttgaacctttctcatggatttttgggggggggggccaatatggnggttacattatataattcctgctgnggcaagtaaaagcacactttttttttctcctaaaaaggttt

SEQ ID NO: 58374 - DNA, 464 bp, Homo sapiens
  misc_feature 18, 23, 33, 37, 55, 105, 148, 276, 329, 396, 421, 455: n = A,T,C or G
gatggaaccaatgaagcngttgncctaactttnagcnctagtgtaccctgaactncttttggaagccacgccactctcttcaccggtgacacttaagtatgtctngcagatgtaccccttgttgtagagtataaaattgcggatatgnggacacttaaaatactacttggctcccaaggatcgaggatgaagaaggatcttaggcattcttaaaattcaagaaaataaaactaagctctttgagaactgcttctaagatgccagcatatactgagncttttctgcaccaaatttgacctctaagtacatatgtagatattgttttctgnaaataacctatttttttctctattctctgcaatttggttaaagaataaagccaaagtcagatctggnctagttaacctagaagtatttttgnctcttagaaatcttgtgatttttataatcaaaanggtcttgac

SEQ ID NO: 58375 - DNA, 110 bp, Homo sapiens
gctgaggtgagaggatcatttgagcccagaagtttgaggctgcagtgagctatgattgcgccactgcactccagcctgggcgacagagtgagaccctgtaccctgtatcg

SEQ ID NO: 58376 - DNA, 143 bp, Homo sapiens
gaagaaatggtcagagaagaaaaatgatggaccaaacgtctgtttgcacaattgaaactctaccagtggactattctattttcacagctacctagtttctgccgatgattttttttaaatgtgaaataaacagtgatactttc

SEQ ID NO: 58377 - DNA, 154 bp, Homo sapiens
ccatgtctgggttgttgtgcctattacctcagcatttctcacaaagtgtaccatgtagcatgttttgtgtatataaaagggagggtttttttaaaaatatattcccagattatccttgtaatgacacgaatctgcaataaaagccatcagtgct

SEQ ID NO: 58378 - DNA, 217 bp, Homo sapiens
  misc_feature 16, 20: n = A,T,C or G
ccagataccgctcttntggntatacacatgaccatgctattatttgctaaacataaaatattgcagtgtattagccagctgtggctccagagtctgtgccctttaccaccgtgcccaactgtttcacatgctgtgtttggtagtttttcctagtgctctccttaataatggtggtgtttagcaaattgtattacataaataaatatttatttcatgg

SEQ ID NO: 58379 - DNA, 398 bp, Homo sapiens
  misc_feature 310, 355, 388: n = A,T,C or G
ccagcgcaggggcttctgctgagggggcaggcggagcttgaggttccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcctcttcatggagtaaaaaatgtatttaaaagaaaattgagagaaaggactncagagccccgaattaataccaatagaaggcaatgcttttagattnaaatgaaggtgacttaacagcttaaaggttagnttaaaaggtg

SEQ ID NO: 58380 - DNA, 448 bp, Homo sapiens
  misc_feature 12, 16, 31, 316, 387, 414, 426: n = A,T,C or G
tggcaggctggngctntgaggaaaccgcttntaagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagctcttcatggagtaaaaaatgtatttaaaagaaaattgagagaaaggactacagagccccgaattaataccgatagaanggcaatgcttttagattaaaatgaaggtgacttaaacagcttaaaggttaagtttaaaaggtgtaggtgantaaaataatttggaaggcgatcttttnaaaaggagattnaaccgagggggattaaaagacc

SEQ ID NO: 58381 - DNA, 416 bp, Homo sapiens
  misc_feature 371, 388: n = A,T,C or G
gatgaccgcgacttcgagccctccctaggcccagtgtgccccttccgctgtcaatgccatcttcgagtggtccagtgttctgatttgggtctggacaaagtgccaaaggatcttccccctgacacaactctgctagacctgcaaaacaacaaaataaccgaaatcaaagatggagactttaagaacctgaagaaccttcacgcattgattcttgtcaacaataaaattagcaaagttagtcctggagcatttacacctttggtgaagttggaacgactttatctgtccaagaatcagctgaaggaattgccagaaaaaatgcccaaaactcttcaggagctgcgtgcccatgagaatgagatcaccaaagngcgaaaagttacttttnaatggactgaaccagatgattgtcatag

SEQ ID NO: 58382 - DNA, 209 bp, Homo sapiens
  misc_feature 124, 155: n = A,T,C or G
ccgtgaggcattccgagtctttgacaaggatggcgatggttatatcagtgcagcagaactacgtcacgtcatgacaaacttaggagaaaaactaacagatgaagaagtagatgaaatgatcagnagaagcagatattgatggagacggacaagtnaactatgaagaattcgtacagatgatgactgcaaaatgaagacctactttcaac

SEQ ID NO: 58383 - DNA, 343 bp, Homo sapiens
tcacagctgaatctcagtgaacagaatagcagtccctggatggcagtctgcctaaagattcctttccctgccttctcccatacattccaaaaggaagttcaacagtaagcagcacctccaagactgtctccttttggccaatatcataagatggacgccataatcctgaggcctcctagaggctgagggggcaacggtgtgatccagctggctcatcccagcccaggtgggccaattattctattttcaagaattttgttgcaagccagttgtcaaacacagccattataattatgtaaatttgcaaattatgttaaaaacaaggacaataaatattcaaaat

SEQ ID NO: 58384 - DNA, 258 bp, Homo sapiens
  misc_feature 23: n = A,T,C or G
tggacgtggggaatttctcctgnggctcagagtgttgtactcgtaaaacaaggatcatcgatgttgtctacaatgcatctaataacgagctggttcgtaccaagaccctggtgaagaattgcatcgtgctcatcgacagcacaccgtaccgacagtggtacgagtcccactatgcgctgcccctgggccgcaagaagggagccaagctgactcctgaggaagaagagattttaaacaaaaaacgatctaaaaaaattc

SEQ ID NO: 58385 - DNA, 137 bp, Homo sapiens
ccaagctgaactccctctaacaacatatttttcagtgcttttatttactatgcacttagactatgcactttttctgaaatatttttgtaacacttttttgtatttttgccatttgaaaaggttgtggtgtagttggt

SEQ ID NO: 58386 - DNA, 466 bp, Homo sapiens
  misc_feature 18, 21, 149: n = A,T,C or G
gtgagcagcccctaacangcncctacttcactacaactgacgatatgatcatcttaatttacttatttctcttgctatgggaagacactcaaggatggggattcaaggatggaatttttcataactccatatggcttgaacgagcagcnggtgtgtaccacagagaagcacggtctggcaaatacaagctcacctacgcagaagctaaggcggtgtgtgaatttgaaggcggccatctcgcaacttacaagcagctagaggcagccagaaaaattggatttcatgtctgtgctgctggatggatggctaagggcagagttggataccccattgtgaagccagggcccaactgtggatttggaaaaactggcattattgattatggaatccgtctcaataggagtgaaagatgggatgcctattgctacaacccacacgcaaaggagtgtggtggcgtctttacaga

SEQ ID NO: 58387 - DNA, 500 bp, Homo sapiens
  misc_feature 19, 21, 30, 55, 61: n = A,T,C or G
agagaccccctcggccctnanggagcgggngacccatcaatgctgatatgatggncttatntacatgaaccaagacaaacaacttcgaatctgggtcacttaaacaagccatctatccaggcattaattcatggactaaacagacattattactccattactattaactatcggaaaaatgaactggaacagaagatgttgctaaatttgcataagaagagttgggtggaaggtttgacacttcaggactacagtgaacattgtaaacacaatgaatcagtggtaaaagagatgttggaattagccaagaattacaataaggctgtagaagaagaagataagatgacacctgaacagctggcaataaagaatgttggcaagcaggaccccaaacgtcatttggaggaacatgtggatgtacttatgacctcaaatattgtccagtgtttagcagctatgttggatactgtcgtatttaaataaagcaacgaaaaacgcta

SEQ ID NO: 58388 - DNA, 190 bp, Homo sapiens
tctttaactcatatttgaatgcacagagggtagcctaccttgggcttacagtcttcttttctcaagaagttcttcatatgtattctaacattgtgatccattagaaacacccatctcttttagtacctctttcttgtgtattttcttggtggtttaagtaattcatgtatcctgcagccgcttttctagt

SEQ ID NO: 58389 - DNA, 100 bp, Homo sapiens
  misc_feature 18, 20, 70, 80, 83, 95, 97: n = A,T,C or G
ctcactgtgcctctaatngncgatgagcgtgttctggggcttcgtcggcttcttggtgccttggttcatncctaagggtnctnaccggggagttntnatt

SEQ ID NO: 58390 - DNA, 417 bp, Homo sapiens
aagttgacatctgacgacgtgaaggagcagatttacaaactggccaagaagggccttactccttcacagatcggtgtaatcctgagagattcacatggtgttgcacaagtacgttttgtgacaggcaataaaattttaagaattcttaagtctaagggacttgctcctgatcttcctgaagatctctaccatttaattaagaaagcagttgctgttcgaaagcatcttgagaggaacagaaaggataaggatgctaaattccgtctgattctaatagagagccggattcaccgttcggctcgatattataagaccaagcgagtcctccctcccaattggaaatatgaatcatctacagcctctgccctggtcgcataaatttgtctgtgtactcaagcaataaaatgattgtttaac

SEQ ID NO: 58391 - DNA, 315 bp, Homo sapiens
  misc_feature 25: n = A,T,C or G
acatttgacttatctggaaaagcanaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaac

SEQ ID NO: 58392 - DNA, 493 bp, Homo sapiens
  misc_feature 1, 14, 33, 42, 77, 283: n = A,T,C or G
ngatggagcggggntgtcgccatgaaaaaaaanccgggggcnactttgtaaatatatgcagtaaagtagtccatgcntacaagtccctaacatggtagatgatgttgcctcccggccctgctcagaaagaatacaaaaagtgtacattcctttttctataatttaagaagtctggaatacagagtgtaacactgtgtactgctagcacccaaagtggaaaatcttaagcattcagattgtttagtcaaagaagaaaaccagaagggcagttgcctattgaggngattttaaacctgtttatttgtaaggattaagtaccctaataggcttaaactatgatagaggtttaatacagaaaaaattgacaggtattataaattgtggatccagttacttgcttatttaatttgtaaagaggtaaaattagctctggttgagatatcaagtatggcaggtatttgagaaggctataaatcataattttcatttagtt

SEQ ID NO: 58393 - DNA, 390 bp, Homo sapiens
  misc_feature 4, 6: n = A,T,C or G
cagncncgcccaggggctaatgttattatcctgtcacacttgcaactagtgacttttgtttagtgatagaagatttggggaggacccaaaggactcagaactttctctccatacctccttttactcttttctttctgtgtaatgtatcaacaactgtttaatctcccttctaacaaaccttgatataagctttctgatatcaaagtatattgacagttaacccttactgattttaaacttgactatccagtctgttaattacctaagattttgttttcatttcatctctaattgttttgatcattggcagagaaagagtatttgaaattcatatcagttttgctccttattttaatctctttgaattaaaaataaaactttttcaaaacg

SEQ ID NO: 58394 - DNA, 326 bp, Homo sapiens
  misc_feature 9, 11, 71, 72, 74: n = A,T,C or G
ccgcagggncncccccggcttccgagggcgcgggcatagcccccaataggccttcgaaggcacaagcccanntntgtcaatatttgtatgtaagaaactaattatgtaataggtaatgaaactgaaactatactatgcccttaaggagatccagtttaattcaaggtgatcttttatttacctgtacaggagtgtaaacttttttgtgcttttatttttcaattgtgagaaccactgattggtatgttcaacaaatttgtgtatacaaagaaatggataaatcactgctatataagggaaactaccttaagaaagaatgtttactg

SEQ ID NO: 58395 - DNA, 302 bp, Homo sapiens
  misc_feature 20, 32: n = A,T,C or G
gttttacaaagtgtttcagnatatttctctanttatgtacaacctaaaatgttggtgttttgtatggatcacaagtgcagcattccttaattccttctgctatatgtcacacagttgttatttggagaaccaagtatgtattgcatgaaaacattatgacttttttctcttagtttaaataaactccaaggtaactggacttctaaagcacctttctgtttgcctgatatctactttagcaataattttttttacaaccctctgactcaacaaagtaaataaaagtatattttatcactatc

SEQ ID NO: 58396 - DNA, 321 bp, Homo sapiens
  misc_feature 179, 281: n = A,T,C or G
gtcattgccacttcaaccaaaatcgatatcagcaatgtaaaaatcccaaaacatcttactgatgcttacttcaagaagaagaagctgcggaagcccagacaccaggaaggtgagatcttcgacacagaaaaagagaaatatgagattacggagcagcgcaagattgatcagaaagctgnggactcacaaattttaccaaaaatcaaagctattcctcagctccagggctacctgcgatctgtgtttgctctgacgaatggaatttatcctcacaaattggngttctaaatgtcttaagaacctaattaaatagctgactac

SEQ ID NO: 58397 - DNA, 252 bp, Homo sapiens
  misc_feature 16, 17: n = A,T,C or G
attacaagagaccaanncgttaaagaatgaaattaaagctctgtctgaggaaagaactgccattaaagagcagctggattcatctaatagtaccattgccattttacaaactgagaaagacaaactagagttggaaattacagattctaaaaaagaacaagatgatctcttggtgctcttggccgatcaagatcagaaaatactgtcattgaagaataaactcaaggatcttggtcatccagttgaagaaga

SEQ ID NO: 58398 - DNA, 285 bp, Homo sapiens
  misc_feature 4, 6, 8, 33, 35, 163, 273: n = A,T,C or G
ggcncncncgcaagaacgccgggcctacagcgntngcgtgaggaaagccgtgcgttgcgttccaaggcatctgtgagcccgcggagtatacaccatgagcaaagctcaccctcccgagttgaaaaaatttatggacaagaagttatcattgaaattaaatggnggcagacatgtccaaggaatattgcggggatttgatccctttatgaaccttgtgatagatgaatgtgtggagatggcgactagtggacaacagaacaatattggaatggnggtaatacgagg

SEQ ID NO: 58399 - DNA, 468 bp, Homo sapiens
  misc_feature 11, 31, 32: n = A,T,C or G
ggcgccctagnatatagtaccgcaagggaannttgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgcccaagatagaatcttagttcaactttaaatttgcccacagaaccctctaaatccccttgtaaatttaactgttagtccaaagaggaacagctctttggacactagaaaaaaaccttgtagagagagtaaaaaatttaacacccatagtaggcctaaaagcagccaccaattaagaaagcgttcaagctcaacacccactacctaaaaaat

SEQ ID NO: 58400 - DNA, 500 bp, Homo sapiens
  misc_feature 11, 14, 60: n = A,T,C or G
cgcggcccctnganggagcgggggggcccttcctgaaggctggcagcattcggttcgagnatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattgat

SEQ ID NO: 58401 - DNA, 207 bp, Homo sapiens
  misc_feature 15, 16: n = A,T,C or G
agtaagttaaggtcnnttcttaatttcttagaattaaaaatacacatatcttgtataccccaaaggtgtgacagtgcaggtgattaatgactgactgaaagcttgagtatagttcagtttataatgataaaatcttaaaatgcagtttaagaagaaatttccaaagaaaagataaagataaaaatagaaaacttgtataaattgaga

SEQ ID NO: 58402 - DNA, 500 bp, Homo sapiens
  misc_feature 2, 13, 33, 37, 43: n = A,T,C or G
anggaccgggggntcccaaagaagggaatgcancagnaacagnttttcaaggtgcacggccagggcctctgtcaagctgtgaggaacatgctgcagagttgtcccctggggctgaggaagctgtgagagagagccactccactcccatcctttgtaggtagagggccaccgccaggctcttagctacttggaactagggccagcttgaggaatatgggtgaggcacccatggcctctgctacattgtttttaatccagtctcaaaaacaaaatggtcctatcacagaaactctgcaaaaatacatgaaagagtaaagaaaaacatgtaaacattttacaattactctatccaaagataaatactgttaaaatgtcagtatgttcttacacaagtttttccatgcatatatgtgtagatttatatacattaagattgtattatacatagaaaataaatttctggacagttatataacctgcccttttcaaaatatatctag

SEQ ID NO: 58403 - DNA, 125 bp, Homo sapiens
  misc_feature 24, 67, 72, 78, 83, 86, 90, 92, 98, 110: n = A,T,C or G
tggggacgtgttaggagagaaaanaaaaaacaaaaatttttttgggggaaattaactttttttttcnttganccaagngcaangcntcananagtttncctatctttgtntgttaagagattaag

SEQ ID NO: 58404 - DNA, 252 bp, Homo sapiens
tcgacgttggccctgtctgcttcctgtaaactccctccatcccaacctggctccctcccacccagccaactttccccccaacccggaaacagacaagcaacccaaactgaacccccccaaaagccaaaaaatgggagacaatttcacatggactttggaaaatatttttttcctttgcattcatctctcaaacttagtttttatctttgaccaaccgaacatgaccaaaaaccaaaagtgcattcaacctta

SEQ ID NO: 58405 - DNA, 497 bp, Homo sapiens
  misc_feature 7, 26, 160, 446: n = A,T,C or G
ctttttngtgagggggcaggcggagnttgcccgaaaccgcagataagtttttttctctttgaaagatagagattaatacaactacttaaaaaatatagtcaataggttactaagatattgcttagcgttaagtttttaacgtaattttaatagcttaagnttttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggngattaaaagaccttgaaatccatgacgcagggagaattgcgtcatttaaag

SEQ ID NO: 58406 - DNA, 182 bp, Homo sapiens
  misc_feature 25, 140: n = A,T,C or G
gatcacttgagcccagggaggttgnggctacagtggccatgattataccactgcactccagcctgggggacagagcgataacctgtcttaaaaaaaaaattgattggaattttttttagaaaacaaagtatacacttagngacttgatacaaatgaatgaatttgataacttacagaacccc

SEQ ID NO: 58407 - DNA, 500 bp, Homo sapiens
  misc_feature 4, 14, 39, 41, 76, 78: n = A,T,C or G
cttnctggggcgcngggaccccgggtaactgggggccgngnaaaccctccaagcaataaaatcattttatgccttntnaactgactccttttttaaaaacccaatgatcacaactaccatactccctcatctattaacacgcagtaaaacagctcaatagcacttttcaaggaactaaatgttttaaatgttatgcagtatgcagggaaaaattattctctagacctttggccagaactttaaaagtgagcattaagtgtaggtacagtctaaattaggggaaggaggcatcacaaagcaattccagggcatattgtcgatccacactattgccagaccaggaacaactggctggacatattttatcagaagactaatgtattttctatagcataagcagttaggctcaattagtgtatgacttaccttgtttcatttcactataccctgacctccttaactgtggctatttttccagtgattctttggagttccgagta

SEQ ID NO: 58408 - DNA, 499 bp, Homo sapiens
  misc_feature 12: n = A,T,C or G
cctaccaggttntccaacgtgtacatgtgtactttatctctctgaattttcaaccacccacggtttattcgaatttccaatagtatattcttttatttaccaaaggtcctggaaactgaaaactctaactgaatttctgaatgtttaatgggagtaaaagagtaattttctctaattcattcacttgagtttccatctggtcaaaatagtctcacatgtttgtcaatattttgaaatgaagtattgcaaaaggtaatatgtagaagaataaataatccagtcatcaacaagggagtacactacagacattgaataaagaagcttcatgcaagcagtacttttttcaggggagaatattatagtctctccctcagaattgccttaaaaatgagcccaagaggcagcttcacagtagattaacatttactaactcccaatccagtactggactgcatgattaaaaggatactaattgggttatcattatcacacatagata

SEQ ID NO: 58409 - DNA, 223 bp, Homo sapiens
  misc_feature 4, 6, 207, 210: n = A,T,C or G
cccnanttttcactgtaaacattagctctttccactgcctacctggaccccagtctaggaattaaatctgcacctaaccaaggtcccttgtaagaaatgtccattcaagcagtcattctctgggtatataatatgattttgactaccttatctgggggtaagatttgaagttggccttttattggactaaaggggaactcctttaanggnctcagttagccca

SEQ ID NO: 58410 - DNA, 453 bp, Homo sapiens
  misc_feature 4, 7: n = A,T,C or G
catnaancgctactaaaaggactggtgtaattttaaaaaaactaaggcagaaggcttttggaagagttagaagaatttggaaggccttaaatatagtagcttagtttgaaaaatgtgaaggactttcgtaacggaagtaattcaagatcaagagtaattaccaacttaatgtttttgcattggactttgagttaagattattttttaaatcctgaggactagcattaattgacagctgacccaggtgctacacagaagtggattcagtgaatctaggaagacagcagcagacaggattccaggaaccagtgtttgatgaagctaggactgaggagcaagcgagcaagcagcagttcgtggtgaagataggaaaagagtccaggagccagtgcgatttggtgaaggaagctaggaagaaggaaggagcgctaacgatttggtggtgaagctagg

SEQ ID NO: 58411 - DNA, 490 bp, Homo sapiens
  misc_feature 21, 22, 32, 36: n = A,T,C or G
gttgccctgtgaggtcagtcnnatggaccttntatnaaacccctcttagtggtcctcctgtatttaattaaccaaataagtgtattcagtagattactcctttatcggctgaatattctcgatgtcaacagtatgagcaacagaaaataaaaacttggaattcagtgacagctttttatgtaactgcctcagttttcttagggtaatcaagccaaagagaaaatcagagatgccaaggatagagtggttgagagaggcccatattgaaataggcacacgattgtcaccatttctcactttacaagctgtataatcagtaagctgattctttttatacttcaaattatatgaacttgacctcatatttggctgcaaataccctgatgattctcaaatctaatgctacatcttagcttattccctcgagctccagacaatgtgtctaaccaaatgtttgcatttgaatgtcccacaggcatttaaatttagc

SEQ ID NO: 58412 - DNA, 388 bp, Homo sapiens
  misc_feature 7, 10: n = A,T,C or G
taggcgnttntttatttttactgtcaaatgatgtgcaaaacctctttactggttgcatggaaatcagccaagttttataatccttaaatcttaatgttcctcaaagcttggattaaatacatatggatgttactctcttgcaccaaattatcttgatacattcaaatttgtctggttaaaaaataggtggtagatattgaggccaagaatattgcaaaatacatgaagcttcacgcacttaaagaagtatttttagaataagaatttgcatacttacctagtgaaacttttctagaattatttttcactctaagtcatgtatgtttctctttgattatttgcatgttatgtttaataagctactagcaaaataaaacatagcaaatgg

SEQ ID NO: 58413 - DNA, 500 bp, Homo sapiens
  misc_feature 25: n = A,T,C or G
gctgagggggcaggcggagcttgangaaaccgcagataagtttttttctctttgaaagatagagattaatacaactacttaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggttgagatgaagcttcttcatggagtaaaaaatgtatttaaaagaaaattgagagaaaggactacagagccccgaattaataccaatagaagggcaatgcttttagattaaaatgaaggtgacttaaacagcttaaagtttagtttaaaagttgtaggtgattaaaataatttgaaggcgatcttttaaaaagagattaaaccgaaggtgattaaaagaccttgaaatccatgacgcagggagaattgcgtcatttaaagcctagttaacg

SEQ ID NO: 58414 - DNA, 498 bp, Homo sapiens
  misc_feature 24, 26, 234, 440: n = A,T,C or G
gctgagggggcaggcggagcttgncngaaaccgcagataagtttttttctctttgaaagatagagattaatacaactacttaaaaaatatagtcaataggttactaagatattgcttagcgttaagtttttaacgtaattttaatagcttaagattttaagagaaaatatgaagacttagaagagtagcatgaggaaggaaaagataaaaggtttctaaaacatgacggaggtngagatgaatcttcttcatggagtaaaaaatgtatttaaaagaaaattgagagaaaggactacagagccccgaattaataccaatagaagggcaatgtttttagattaaaatgaaggtgacttaaacagcttaaagtttagtttaaaagttgtaggtgattaaaataatttgaaggcgatcttttaaaaagagattaaaccgaaggngattaaaagaccttgaaatccatgacgcagggagaattgcgtcatttaaagcctagtt

SEQ ID NO: 58415 - DNA, 145 bp, Homo sapiens
  misc_feature 31: n = A,T,C or G
ggaagcgcggctaaaaactcatactttatcntttttggttgcctctctcagttactgccgtttatagaataattgagcttgaaccatgtgaatgttcagaatgtcaatggtggagtatttattcaagagaaatggctgaatctcg

SEQ ID NO: 58416 - DNA, 230 bp, Homo sapiens
  misc_feature 3: n = A,T,C or G
cantaaaaaaaaatcccctttgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattat

SEQ ID NO: 58417 - DNA, 252 bp, Homo sapiens
  misc_feature 4, 18, 35, 46, 49: n = A,T,C or G
ctcngagggccgggcatnacaccgcctcagtagtntgttcccttantanacatttagatgtgcacaaattaatccttttatatatctaaaggtttttctatcatgcattggattgctcagaataaagtgtctgttagacttcgttttggtaaataaattctccataatgtagattaataatataaaagtctttaatgacacaatatatctatatagcctcactgtataattcagaaataaaaattgattctg

SEQ ID NO: 58418 - DNA, 295 bp, Homo sapiens
  misc_feature 4, 20, 294: n = A,T,C or G
gttnattttcttggcaatgnaagcaatttttaaagataccagtgggacaggtttggttttttaaaaatctcatgtgttcaaattaacataaatattacacgtcaatacactgtacatggtggtaatagactctaagcaattgccaagatgtattctatttttatgaagtgtatatatattaccttagtgtgcattttctatataatatcttgatggactcttttataaaattattttataaaaaacaatgttacactaaaatcagcctaaataaattttcacaactttttttcnt

SEQ ID NO: 58419 - DNA, 499 bp, Homo sapiens
  misc_feature 15, 49, 56: n = A,T,C or G
accccgctctctttnatggggcgggaatatccacaaatgcacatatagnagttaanttttttagtgaacacttgtttagtgtcactcagtttgctaggtgctgatatgtacgtatatctcaatgtgtctgtagacttagatacatcctcttgaagcacatccatttctttagcgtctctcagtaagttacagtacttgtttgacttaggtttaagaggcccagctacctatctctgaccttttcaaataggctcatttgggagattcttttgccaggagagattcaactttccaatctaagtattccagagcattgcccaggcagagttggtttgatgtggccagatgttttgagttatttcccttaagtgtttcactggggagagaacagggagtgctcctccagcttcccaaagaaatatgtttttgtaagtggtaggaacatgtgcacacaatagaacatgaaataagttttttaacttgtaaaacatgtcaagat

SEQ ID NO: 58420 - DNA, 192 bp, Homo sapiens
  misc_feature 23, 72, 75, 90, 184: n = A,T,C or G
tgagggggcaggcggagcttgangaaaccgcagataagtttttttctctttgaaagatagagattaatacanctncttaaaaaatatagncaataggttactaagatattgcttagcgttaagtttttaacgtaattttaatagcttaagattttaagagaaaatatgaagacttagaagagtngcatgagg

SEQ ID NO: 58421 - DNA, 100 bp, Homo sapiens
  misc_feature 30, 38, 51, 69: n = A,T,C or G
tctgctgggaaaatactttaataaaattcnttcaaatnaccttcccaattnagtttggtcgggggagcnccctttaaaaaaattcccggggctggctttt

SEQ ID NO: 58422 - DNA, 131 bp, Homo sapiens
  misc_feature 9, 22, 31, 34: n = A,T,C or G
agcgggaanatcccagttgatnattaaggcncanttttttttttttaactaaaaaattggcggcccgggtgggggggggcaatcatttttcttcctatacatacaaaggatattgtcaaaaatggcgttct

SEQ ID NO: 58423 - DNA, 500 bp, Homo sapiens
  misc_feature 2, 26: n = A,T,C or G
tntcaaagaccagttcttcaatatanctcagtcagacaaaaataaagaaaaaaataaaaattattatgtaaagagaacaactcagccactcattggtgttcttgaaagagaggcagagaaggcaagcaacttggaaaacatatttgaggatattattcacaaaaatttccccagcctcactggagaggacaacattcaaattcaggaaatgcagagaactcctgtgaggtactatacaagatgaccatcccaaagacaccatgtctccaagacatagtcatcagattcttcaaggttgaaatgaaagaaaaaatgttaaaggcagctagggagacagggcgggtcacctacaaagggaaccccatcacgctaacagtggacttttcatcagaaatgctacaagccaaaagagattggggcctgtactgaacattcttaaaagaaattccaaccaagaatttcatatctagccaaactaagcttcataagtgaatgagaaa

SEQ ID NO: 58424 - DNA, 228 bp, Homo sapiens
  misc_feature 24: n = A,T,C or G
catctgattctgtatttaatatcnaaatgggatcagtgacactggtaggatgggtgagagaagaaaattggctaaaattgcatcatggaagatcaggcttggatggggtgccataggtgggcctgaggggcaacatgagatcccaggagcacaaacttagaggggtgttgaaagataccaagacaaactgtctgctttaacattttgccaacagcccttctgagcctc

SEQ ID NO: 58425 - DNA, 370 bp, Homo sapiens
  misc_feature 2, 32, 367: n = A,T,C or G
cnacccaaaaagaaattttgcctgccattttnagaatcatcttttgaagctttctgttgatgttaactgagctactagagatattcttatttcactaaatgtaaaatttggagtaaatatatatgtcaatatttagtaaagcttttcttttttaatttccaggaaaaaataaaaagagtatgagtcttctgtaattcattgagcagttagctcatttgagataaagtcaaatgccaaacactagctctgtattaatccccatcattactggtaaagcctcatttgaatgtgtgaattcaatacaggctatgtaaaatttttactaatgtcattattttgaaaaaataaatttaaaaatacattcaanaga

SEQ ID NO: 58426 - DNA, 126 bp, Homo sapiens
ctgactcctgccagccctatggaagttccttttatgcattggaggaaaagcatgttggcttttctcttgacgtgggagaaattgaaaagaaggggaaggggaagaaaagaaggggaagaagatcca

SEQ ID NO: 58427 - DNA, 190 bp, Homo sapiens
cgcccactaagccaatcactttattgactcctagccgcagacctcctcattctaacctgaatcggaggacaaccagtaagctacccttttaccatcattggacaagtagcatccgtactatacttcacaacaatcctaatcctaataccaactatctccctaattgaaaacaaaatactcaaatgggcct

SEQ ID NO: 58428 - DNA, 500 bp, Homo sapiens
  misc_feature 7, 19: n = A,T,C or G
tgcgggngcccttgcgagnagaaaaggggaggatgccactggagtcatcctcttcaatgccactatccttcccatctctcttaccctcagtaccacacaatactaacccttcccctcctctgatgtcttacatcacctcccaggagatgaagtgtattcttcactggtttgccaattgggcaggtccccagcgtgaacgtttcctagaggacctggtagctaaggcagtgccagaaaaattacaaccactgctggatagtctggagcagcttagtgtgtctggggcagaccgaccaccttctatctttgagtgccagctacatctttgggatcagtggtttcgaggctgggctgagcaggagcgcaatgaatttgtcagacagctggagttcagtgagccagacttcgtggcaaagttttaccaagcagtggctgctacagctggtaaggactgataggcattcagaccaaagaagataaccatagctgatggagccatg

SEQ ID NO: 58429 - DNA, 498 bp, Homo sapiens
  misc_feature 27: n = A,T,C or G
taatgacagcagtttctaaccaactcncatatttatagcatcttatgaagatattgtaaggcttagcatattttgccactggttttctttgtaatataggttgaaagtgagacatgtttgaatacctttgtatgtaaatatctcccattctttttctatctcttcttggtctatatttactaagaattgatatttaaaaaacagttcactaatgaactctacatattattgaacactcacagggcaatattgatttgggtgctacctagacttttacctaacattagtctttctcaatagttgttgtaaaggatagtattcaatccagtaaatattaaagtgtattagtttaatgaaggttatttatatactgtcataccacaaacctatggtggaaagaacatctgcattcaccagaatgtacttgttcctttggctgtgaataaattggataagacttttttattgtaagttccagctgttggaagatacggggat

SEQ ID NO: 58430 - DNA, 338 bp, Homo sapiens
  misc_feature 6, 31, 34: n = A,T,C or G
gtcccncttactttgtaagaatgggtggganttnatgctgattttcaatccttttgcagatcttctctcatagtaacacaatagaagatactttgccactatgttgtttgccaaactcactgtacctacttgactggtaacaaaagtcccaagagttatttgggagaagacacttgaaaaagtatttttctaaatatgggcaaggatgctgcccttccccaaactgttagtataccacctctctgaccaattttcccaaggaagatattggggtagggtgaggtgtaaagaaaaagtggtcatgtaaatactggtaataaaagctgttcagtgggaca

SEQ ID NO: 58431 - DNA, 500 bp, Homo sapiens
  misc_feature 24, 130: n = A,T,C or G
gctttagtttttactactttgaanggaggttcatctaagtattactgataacagggatccaacttaaagtaaaagttggaaagggcaagagtcttttaagcggaacttcaattctgttgtcatggttacnttatatataatgaatataaatagacaaataggacttggaaaatgtggtatattctaagtcaagatgctatgaagttgttatagtttaagggacattcttaagaaggaattacttaagtacattactcttctcattttcaaggacatgaaaaagtaaaggatggtctggcactattttattttatttttttttgacttgtactgaatatatgtactttgaagatttacatctataactagaaagtatgctaatccgaggtctggttattaggccagattcttgttcagttattttttaaactaatgttgcctcctttttagtaagattctacgaaagttttttaactattaaagttatttcttaaggggga

SEQ ID NO: 58432 - DNA, 338 bp, Homo sapiens
  misc_feature 2, 5: n = A,T,C or G
gngancccagaaagaggacaaaaggctattttacttcaaggctaaaaacctccaagcattgagaggccaggaggaggaggagaaccctatgaatgaaactgagaaggcatgcccagggagataggaggaaggcaagcgggcacagtgtgctgacagccaagagaagaaactatgtcagagggggaggtgcaatcaagaaagatgatggcttagatataacctgataattttacaatatggacctcaatggggtcctggctagagcaatttggtggaatgctgtaattctggaaagtctttcgcatgatatttaattttaaaaagtcaagtgtaacctc

SEQ ID NO: 58433 - DNA, 500 bp, Homo sapiens
  misc_feature 26, 82, 330, 350, 382: n = A,T,C or G
tcatctctatttaaaggaaaataccnccgattttaaagttcctgaaaccatagccatattttgacatttcacaaagaatggntctagtctactagagtacatttggctaagtagataacttacctaaatttgctccaaagctaaatcacaagtaaacatatttatgtttaaaacacagaaataaataacttaagatttttatctaagcggtcagtgttgtattggaaagatatatctataaataaactttgaactgatttcaaacttagaatttatgtttttatatttttccactaatatcattatcacttctgtaattttcagtgtggncatcattaactcaatacagncattcattttattgacttgtgattcttctggngtcatttggaactttatatgattcctgaagaaattccatttttagtcaaaataatcttctatatcaatatttggatctagcagatcttctccatatgatgaaagattcatttgggtta

SEQ ID NO: 58434 - DNA, 385 bp, Homo sapiens
  misc_feature 7, 61: n = A,T,C or G
atagtcncaggatgttttatgaagtcacaagtttttatatatttttattttgacctaaacntgtacagtcccattgtaagtgttgtttctaattatagatgtaaaatgaaatttcatttgtaattggaaaaaatccaataaaaaggatattcatttagaaaatagctaagatctttaataaaaatttgatatgaaaagcacaatgtgcagaagttatggaaaacctatagaggattacaacaggtaaacgttaaagagaatacattgctgacttatagtgatgtggctaagaagtacatgctttgttgtaaaattgcttgaaagcccattgaaagatgtatctgtttatttacagtctttgaagtaaaagttaccaatgtttgcc

SEQ ID NO: 58435 - DNA, 184 bp, Homo sapiens
  misc_feature 46: n = A,T,C or G
ccttgttcccgtctggataccagcttccttcagcagcgcaggcggnggtccctgaggcccgtggaaggagtcaaacttgcgggaattttgcagtttatctgcagggctgttgtttccagcaagacccaaagctagaaaaggaggaggaagaaactgacccgatcagtgccagaagtcattgtat

SEQ ID NO: 58436 - DNA, 164 bp, Homo sapiens
cggagtgctgtgccacctggtgccgacaagaaagccgaggctggggctgggtcagcaaccgaattccagtttagaggcggatttggtcgtggacgtggtcagccacctcagtaaaattggagaggattcttttgcattgaataaacttacagccaaaaaacctt

SEQ ID NO: 58437 - DNA, 498 bp, Homo sapiens
  misc_feature 26: n = A,T,C or G
taacaggaccttatgattacaaatcnggatcatttctgctaaagttcaagttcacatagattcctagaatgtgtgactctaagttatgttaatctttggcatcaaatctcctccgtagatttttttcccttaggcaagaaaacaaaatagattgatttgaagcaaattcttataagcgatggcaaaccccaaaaagaagggaaagagacttggttggtgagaatagtaattttgccagcataggactaactgcaaaaccaacagctttgtcaccaaaggagatatatgatatactcattcaggaagatagtgaatatatatgtgtggggtttaggggagaggggaatctatgactttgccagctaaaagtggttgatgcagaaatgcatggagtaaagctgcaactttgatggcccaaggtgacgatccaagttaaagaatattctgaaaattagacatctataaaaggactgagataagctctccacacattcccag

SEQ ID NO: 58438 - DNA, 487 bp, Homo sapiens
aactatcagtaattctcaagcaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgcctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaatttccaggaaaaaaataaaaagagtatgagtcttctgtaattcattgagcagttagctcatttgagataaagtcaaatgccaaacactagctctgtattaatccccatcattactggtaaagcctcatttgaatgtgtgaattcaatacaggctatgt

SEQ ID NO: 58439 - DNA, 496 bp, Homo sapiens
tgtcttaaatgattctttgtgtaccttttctgtcatattcagaaaccgttttgtgcctgctgggagtaattcctttagcaattaagtatttggtagctgaataaggggtcagaacttctgaaaccagagatctgtaatcatctctattggcctggggtgcctgtgctataaatgagtttcttcacatgaaaaacacagccagcccaagatgacttatctgggtttaggattcaatagtattcactaactgcttattacatgagcaatttcatcaaatctccaaactcttaaaggatgctttcggaaaacacgctgtatacctagatgatgactaaatgcaaaatccttgggctttggtttttttctagtaaggattttaaataactgccgacttcaaaagtgttcttaaaacgaaagataatgttaagaaaaatttgaaagctttggaaaaccaaatttgtaatatcattgtattttttattaaaagttttgtaat

SEQ ID NO: 58440 - DNA, 266 bp, Homo sapiens
  misc_feature 52: n = A,T,C or G
taaaatagtgggaagatttataggcagaggcgacaaacctaccgagcctggngatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaaatttagcacccatagtaggcctaaaagcagccaccaattaagaaagcgttcaagctcaacacccacta

SEQ ID NO: 58441 - DNA, 499 bp, Homo sapiens
  misc_feature 24: n = A,T,C or G
atgcctccgctgaaggccccgagngcgaaggtaccgaaagcacagtaatcactggtgtcgatattgtcatgaaccatcacctgcaggaaacaagtttcacaaaagaagcctacaagaagtacatcaaagattacatgaaatcaatcaaagggaaacttgaagaacagagaccagaaagagtaaaaccttttatgacaggggctgcagaacaaatcaagcacatccttgctaatttcaaaaactaccagttctttattggtgaaaacatgaatccagatggcatggttgctctattggactaccgtgaggatggtgtgaccccatatatgattttctttaaggatggtttagaaatggaaaaatgttaacaaatgtggcaattattttggatctatcacctgtcatcataactggcttctgcttgtcatccacacaacaccaggacttaagacaaatgggactgatgtcatcttgagctcttcatttattttgactgtga

SEQ ID NO: 58442 - DNA, 407 bp, Homo sapiens
  misc_feature 297, 304: n = A,T,C or G
tactatctctaccttctgttgacactaatcaaacaaaataatagtatgttcgtggttttgttacaaatgattttctaaaatttaacagaaacctgcattattcaggaacactaaaaatgtacatttaaagtaattgtttattaaactgtaacaagttttctagcaattttagattgaatttgatgctctcaaactgctttacatacctgcgataattacaaattaaatttttgggtaagactttgctgtaactgtggtaattagaaaaaaaaaatccacactaaacatgagacaagngtctgtngaccaaagagaaaagaactttccagtgcgttacatggattttacaacagagaagttgcttccacaatagaattgatgtccccttgacaccgcctttgggaagg

SEQ ID NO: 58443 - DNA, 292 bp, Homo sapiens
cctgtttcttggcatgtcatgtgcatgcagctcttcggtttcctggctttcatgatattcatgtgctgggtgggggacgtgtaccctgtctaccagcctgtgggaccaaagcagtatccttacaataatctgtacctggaacgaggcggtgatccctccaaagaaccagagcgggtggttcacctatgagatctgaggaggcttcgtgggcttttgggtcctctaactaggactccctcattcctagaaatttaaccttaatgaaatccctaataaaactcagtgctgtgtt

SEQ ID NO: 58444 - DNA, 344 bp, Homo sapiens
  misc_feature 23, 151: n = A,T,C or G
agatttggctgtctccgctcatngctgcttttggcgcgaaagatgccgggtctggttgactcaaaccctgccccgcctgagtctcaggagaagaagccgctgaagccctgctgcgcttgcccggagaccaagaaggcgcgcgatgcgtgtntcatcgagaaaggagaagaacactgtggacatctaattgaggcccacaaggaatgcatgagagccctaggatttaaaatatgaaatggtggtctgctgtgtgaataaataattcctgaagaatgaagaagattaattttgggagttctttgacgaactttgatatgtggaaaaagtatttataattttattgc

SEQ ID NO: 58445 - DNA, 495 bp, Homo sapiens
  misc_feature 444: n = A,T,C or G
accacgttggccaggctggtctcaaactcctgacctcaggtgatccaccctcctcggcctcccatagtggctgggattacaggcgtgagccactgcacccagcctctatttaaaattctttatttctgttttcctaatttgattaatacagctgtaaaaatagcaaacgtgtatctaaagtgttatttcagtggcaaaggaatgtttttattttgtcgaatttatatgtgatttttaagtgaaatatttgtgtggatcttggggttttggtagcgtataaagccaataaaatcagagacttagggcttcagaagggaaaaaatcctcaacatcacattcagcaatggtttagattcatgaacaagttgatagtcaaatcctgagtataaaatactttgcattctatcaacttctcaaattactagtaagaacttcatattttgngtgattctctcattgactgttttcatcttttccttaaataaaaccaggagc

SEQ ID NO: 58446 - DNA, 410 bp, Homo sapiens
  misc_feature 1, 49, 57: n = A,T,C or G
ntagcccagaacccaacctccgagcagtttttgctaagacttcaccagncaaagcgnactactatactcaattgatccaataacttgaccaacggaacaagttaccctagggataacagcgcaatcctattctagagtccatatcaacaatagggtttacgacctcgatgttggatcaggacatcccaatggtgcagccgctattaaaggttcgtttgttcaacgattaaagtcctacgtgatctgagttcagaccggagtaatccaggtcggtttctatctacttcaaattcctccctgtacgaaaggacaagagaaataaggcctacttcacaaagcgccttcccccgtaaatgatatcatctcaacttagtattatacccacacccacccaagaacagggtttgtta

SEQ ID NO: 58447 - DNA, 247 bp, Homo sapiens
  misc_feature 26: n = A,T,C or G
cgaaaccagacgagctacctaagcancagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagt

SEQ ID NO: 58448 - DNA, 299 bp, Homo sapiens
  misc_feature 6, 14, 166: n = A,T,C or G
cccacngttttttnaactgaacgcaaatcagccactcctaattaagctaagcccttactagaccaatgggacttaaacccacaaacacttagttaacagctaagcaccctaatcaactggcttcaatctacttctcccgccgccgggaaaaaaggcgggagaagcnccggcaggtttgaagctgcttcttcgaatttgcaattcaatatgaaaatcacctcggagctggtaaaaagaggcctaacccctgtctttagatttacagtccaatgcttcactcagccattttacctcacccc

SEQ ID NO: 58449 - DNA, 168 bp, Homo sapiens
tgagtactacttttcctaccttgaaaatctatttcatttactaaatattgttttctttatgctaacttaactttaaaaggaatgttgccaagctgtctctcctcccccatcacaattgttagttttttttgctttctttcttcaataaatgatagcattatgatcttt

SEQ ID NO: 58450 - DNA, 237 bp, Homo sapiens
  misc_feature 22, 230: n = A,T,C or G
ccactagtttattaacttccantcaccttgatttttgctaaaatgaagactctgcagtctacacttctcctgttactgcttgtgcctctgataaagccagcaccaccaacccagcaggactcacgcattatctatgattatggaacagataattttgaagaatccatatttagccaagattatgaggataaatacctggatggaaaaaatattaaggaaaaagaaactgngataata

SEQ ID NO: 58451 - DNA, 120 bp, Homo sapiens
ctggaatattacctgtgtcatcaaagtagtgatggattcagtactcctcaaccactctcctaatgattggaacaaaagcaaacaaaaaagaaatctctctataaaatgaataaaatgttt

SEQ ID NO: 58452 - DNA, 500 bp, Homo sapiens
  misc_feature 23, 24: n = A,T,C or G
tgctttgccctggagcagctatnntaagccatctcagattctgtctaaaggggttttttgggaagacgttttctttatcgccctgagaagatctaccccagggagaatctgagacatcttgcctacttttctttattagctttctcctcatccatttcttttatacctttcctttttggggagttgttatgccatgatttttggtatttatgtaaaaggattattactaattctatttctctatgtttattctagttaaggaaatgttgagggcaagccaccaaattacctaggctgaggttagagagattggccagcaaaaactgtgggaagatgaactttgtcattatgatttcattatcacatgattatagaaggctgtcttagtgcaaaaaacatacttacatttcagacatatccaaagggaatactcacattttgttaagaagttgaactatgactggagtaaaccatgtattcccttatcttttacttttttt

SEQ ID NO: 58453 - DNA, 160 bp, Homo sapiens
  misc_feature 44, 155: n = A,T,C or G
catgccaagaatgttttcttaccaaattctctttttattgaggnttcactaataagcagcttctacttttgagcctcaacttaaagcagaactgttttctactggatttttcattaacagcaagctttttcttttatgtaaaataaatctattgngaatt

SEQ ID NO: 58454 - DNA, 500 bp, Homo sapiens
  misc_feature 11, 21, 33, 35, 39, 45, 50, 78, 99, 103, 111, 135, 194, 225,255, 287: n = A,T,C or G
ctttctagganctcggggacnccccgccccttnanggtncgggantgacncagaaaggaaggaacactaaagctggtntttctcttctaggtagaagcntganacgttgancagccttaatagtaatcagtaatngtcccgtatccttgaatgctatatttgctcaaaacatccctttgacttttctaagtgtntgcttaagcagagagtaagaatgtgtggttncctttggtctgagatcctttccattctttntgactctctgcttcagattttttcaggagtgngagtcaccaaaacatttactaagagtaattgggtttaggatgttggaaatttttagcttgggggaaaaaacattcttatgaaggagataggttctcttctgagtttgtcataatatagattggtgtctttggaaaatggccacaattttaagaattcaattatgcatataaaatgataattattggaattccacagtaacagatttaaacagt

SEQ ID NO: 58455 - DNA, 275 bp, Homo sapiens
  misc_feature 30: n = A,T,C or G
tgcagcggctcacgcctgtaatcccagcantttggaaggctgaggcaggtggattacctaaggtcaggagtttgaccagcctggccaacatggcgaaatgccatctctaccaaaaacacaaaaattagccagatgtggtggcatgcacctgtaatcccagctactcgggagcctgaggcacaagaatcacttgaacccaggaggcagaggttgcagtgagctgagatcacgctactgcactcccccgactgggtgacagagtgaaactgtatctc

SEQ ID NO: 58456 - DNA, 245 bp, Homo sapiens
attttttaattattggttatattttcaattcaaaaatgtacaaaataaagttacattgctggtcttgtaagagctatacagttttcctaaatgtatacctgtaactgcagcagttcacctatttcaaaaatttggaattctgttcatttgttattcttaagaccacctcaaatttaaaggctaccttattgtacgtttaaagtgtattataacagtgtggtagttaataaaacactattttttat

SEQ ID NO: 58457 - DNA, 480 bp, Homo sapiens
  misc_feature 7, 25: n = A,T,C or G
agaccanaataagccttttaaggtncacctcaaaattatcattttatggtaatactgaccattttagtcccctaggtttgacatgggagatagtgactacactggtgtctgacttttttcctagagatttctccctgaaaaatacaagggctgttggtgagagcagacttgaggtgatgatagttggcctctggtctacaaagatttcataactccttggaaagcttcttataatcattcttaacttcttggtagctagaaatttagagtagttgaaatctttaggaatgaacttctgagggccaaaaaatgtgactgacgggaacaattcttaaactgattaactagctgtaatatagttttgtgaatttattgcactgatgttgtaccttgtggtatatctgtccctattaaataagtgttgttttctcctctttaatattgctgtgaacagtggtgcccattgtagcatatgtttga

SEQ ID NO: 58458 - DNA, 499 bp, Homo sapiens
  misc_feature 10: n = A,T,C or G
gagaattccngaagctgacagcattcgggccgttttgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgcttttttaatattgatatgcttatacacttacactttatg

SEQ ID NO: 58459 - DNA, 497 bp, Homo sapiens
  misc_feature 2, 39, 66: n = A,T,C or G
ancggggaattccccgaagtctgacagcattcgggccgntttgtctcgctccgtggccttagctgngctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattgatatgcttatacacttaca

SEQ ID NO: 58460 - DNA, 469 bp, Homo sapiens
tgaaaatgaggcctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagtgataagaggaatttgggtataattatggtgggtgattattttttatactgtatgtgccaaagctttactactgtggaaagc

SEQ ID NO: 58461 - DNA, 281 bp, Homo sapiens
  misc_feature 2, 11, 42: n = A,T,C or G
tnggtgtgatnaccaacagagagaggcaccctggatcttttnacgtggttcacagtgaaagatgccaatggcaacagctttgccactcgactttccaacatttttgttattggcaagggcaacaaaccatggatttctcttccccgaggaaagggtatccgcctcaccattgctgaagagagagacaaaagactggcggccaaacagagcagtgggtgaaatgggtccctgggtgacatgtcagatctttgtacgtaattaaaaatattgtggcaggattg

SEQ ID NO: 58462 - DNA, 366 bp, Homo sapiens
  misc_feature 5, 9: n = A,T,C or G
cccgnggtntatacaccatgagcaaagctcaccctcccgagttgaaaaaaatttatggacaagaagttatcattgaaattaaatggtggcagacatgtccaaggaatattgcggggatttgatccctttatgaaccttgtgatagatgaatgtgtggagatggcgactagtggacaacagaacaatattggaatggtggtaatacgaggaaatagtatcatcatgttagaagccttggaacgagtataaataatggctgttcagcagagaaacccatgtcctctctccatagggcctgttttactatgatgtaaaaattaggtcatgtacattttcatattagactttttgttaaataaacttttg

SEQ ID NO: 58463 - DNA, 434 bp, Homo sapiens
  misc_feature 1, 52: n = A,T,C or G
nccgcaagcgtcagcctagaagcaatggcgattttctggcaagcggtctatngcccgctgaatcagacacttggaaaagaacaaaacagctcacaggacccaacctagtgatgcaatctactggagtgctcacagctacaagggaaagaaaagatgaagaaggaactgaaaaacttactaacaaacagataggttagtgaagaaaaatgcaaagtagcaatgagaaggcttatggagtaaaaatgaagtcagttggtatttaatcccaaagtgttgttctgattatctaaaatttgacatggtagaccttgcaatctagaatcaagcaggtgagacagggagaagtatgcctgcttaattatttaaactgtgtacttttgttttgacactgaatattttaaaaagcaaataataaaataactaagcatttgagg

SEQ ID NO: 58464 - DNA, 288 bp, Homo sapiens
  misc_feature 2, 7: n = A,T,C or G
gntatancatacatcatattttttgctcatttgtgagatttaaatttcagttaactcctttactgatttatgctttctcagaacttcaaacatcagtgagttgatggcatccatatctctgtttttatctctgtttttacacccatacatacaaaagaatatatagggcatgagcagaatgtggtggtatgcatccgtagtcccagctactccagaggctgtggcaggaggattacttgagcccacaaggttgaatccagcctggacaatagagtaagaccctgtctc

SEQ ID NO: 58465 - DNA, 442 bp, Homo sapiens
  misc_feature 2, 14, 45: n = A,T,C or G
tntctaccataagnttttggtctgctgatttgctgccctgtcttntcttactttactttatcaatacctggcaaactgaccagaattaccttcctcatggcaaagggggattatggtgaattgttgttcttatagtctgtttcatgaagcacaagtggaatttaatacataaaagagaaaaatatcttagtttgctaccagcatccagcatgaagttgtaaagtggggattaggcaccgtgacagtatagcacccatttgaatttaaataaaagtgaaccatatttatctggttatataaaactaaaaatggggggtttatataaaactaaaaactaagaatgatgtaaccttttgctgtgttatctgaacactctacttcctttgcagccttagtcacacaactgagcatctcaagtctctttaaggaacacagcccaggc

SEQ ID NO: 58466 - DNA, 427 bp, Homo sapiens
  misc_feature 20, 21, 39, 43: n = A,T,C or G
tgctgcgtcggcttgccttnntgctagcaaccctttccnttgntgtgcactgaaacgtgaagtcctgttttgaatgtcaaacccaccattcactggtgctgactacatagaatggggttgagagaagatcagtttgggcttcacagtgtcatttgaaaacgttttttgttttgttttgtaattattgtggaaaactttcaagtgaacagaaggatggtgtcctactgtggatgagggatgaacaaggggatggctttgatccaatggagcctgggaggtgtgcccagaaagcttgtctgtagcgggttttgtgagagtgaacactttccactttttgacaccttatcctgatgtatggttccagggatttggattttgattttccaaatgtagcttgaaatttcaataaactttgctctgtttttct

SEQ ID NO: 58467 - DNA, 269 bp, Homo sapiens
  misc_feature 12: n = A,T,C or G
gagtcactggcncttagaagcctgcccacgattcctaggaaggctggcagacaccctggaaccctggggagctactggcaaactctcctggattgggcctgattttttggtgggaaaggctgccctggggatcaactttccttctgtgtgtggctcaggagttcttctgcagagatggcgctatctttcctcctcctgtgatgtcctgctcccaaccatttgtactcttcattacaaaagaaataaaaatattaacgttcactatgctg

SEQ ID NO: 58468 - DNA, 422 bp, Homo sapiens
  misc_feature 5, 12: n = A,T,C or G
atctntagaatntggcatgggaacaaatgatgaagatgaattaagccttggtttgcccactgagctcaagagaaagaaggaacagttggacagtggtcacagaccaagcaaagagacgcaatcagcagctggtctcacccttcctctgaacagtgaccaaacctttcacctgatgagcaacctggctggggatgttatcacagctgcagtgactgcagctatcaaagaccagttagagggtgtgcaggcaagcactttctcaggctgccccatcccagaagaggacacagacactgaagaaggtgatgactttgaactacttgaccagtcagagctggatcaaattgagagtgaattgggacttactcaagaccaggaagcagaacacagcaaaataagaagtcttcaggtttcctttcaat

SEQ ID NO: 58469 - DNA, 100 bp, Homo sapiens
  misc_feature 10, 23, 38, 39, 44, 61: n = A,T,C or G
tgtttaaggnggtataagcaatntaacaattttgatgnngaatnaataattcccctttggnaaaaaagagctgaagttatctaagatcagcatactgttg

SEQ ID NO: 58470 - DNA, 258 bp, Homo sapiens
  misc_feature 5, 17: n = A,T,C or G
ccacntgaccaacttgngcaagatgggagcgcccgaatctggcttggcggaatatctctttgacaagcacaccctgggagacagtgataatgaaagctaagcctcgggctaatttccccatagccgtggggtgacttccctggtcaccaaggcagtgcatgcatgttggggtttcctttaccttttctataagttgtaccaaaacatccacttaagttctttgatttgtaccattccttcaaataaagaaatttggta

SEQ ID NO: 58471 - DNA, 226 bp, Homo sapiens
  misc_feature 16, 41, 53, 59: n = A,T,C or G
tgatgatcccgatgangatgatgatgatgatgatgaggacnactctctttttncagttngagagccaagaagccattttttccatttgatctgtttccaatgtgtccatttggatgtcagtgctattcacgagttgtacattgctcagatttaggtttgacctcagtcccaaccaacattccatttgatactcgaatgcttgatcttcaaaacaataaaattaagg

SEQ ID NO: 58472 - DNA, 449 bp, Homo sapiens
  misc_feature 7, 10, 33, 40, 87, 89, 279, 296, 343, 422, 430: n = A,T,C or G
aaaaagnccnagtgagcacgcctggatgacctnctctgangcctattttaaattattatgaatgatcacatagaaactctttagtantnatctaaagtaattattactctacttcgtttgtttatctaaatcagtgatcattgatgtttgaactttttggcttaaatgtttattttgtttatactacttgctagagtaaaataaatttaatacatgaaaaactctacacaatttaaaataggttataatttgtcaatacttatgttttaaaatattttnagaaggaggagtgctgnatattattaaaacaattttctgaaattgttaatattatctttgattntaaaatgacatatatgtggattacaatgaatcaaattgtcctaaaagatgtcagataagaaatgcaagtgcttgcaagnctaatctnaatggtcttttatgtacac

SEQ ID NO: 58473 - DNA, 469 bp, Homo sapiens
  misc_feature 5, 8, 58, 59: n = A,T,C or G
gatanaancagcatcctctgccaagaccaaaaggaaagaagaaaaagggccaaaagcnnaaatgaaactgatggtacttgttttcaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgcccaaaagacgttttctttggaccaaagatctctttcgtgattccttgcaacaatcaatgagaatcttcatgtattctggagaacaccattcctgatttcccacaaactgcactacatcagtataactgcatttctagtttctatatagtgcaatagagcatagattctata

SEQ ID NO: 58474 - DNA, 419 bp, Homo sapiens
  misc_feature 11, 19: n = A,T,C or G
ctgaatatggnagactgtnataggcattctgttattgtcttggattgttgctacaattgtctaatttacagcagttgtgatcccacaaaaagcaagtttatacctcagattggggtataaaaattgtttttcgctcagtatttactggaaaatggacatcactagtctttcagtaagatttctctcaaaacacgtgaaaaccttggtaaattgcaattctttctggggatatattggtacaacatgacttaaagctttttttttctattaaaacttaaaggggaacaaaacttgaaaaagccctgttcttcagaaggtgagtgggttgagggaggcagtaatatgaagtgactgctgtgtattttaactaccagattttttatatttgccactgttaaatagttggaaaggggaaattc

SEQ ID NO: 58475 - DNA, 278 bp, Homo sapiens
  misc_feature 4, 13, 28: n = A,T,C or G
cagncgaagtgtngtcacacctgtattnccagcactttgggaggccaaggtgggttggatcaccagaggtcgagagatcgagaccagcctgaccaacgtggacaaaccctgtctctactaaaaatacaaaattagccatgtgtggtggcgcatgcctgtaatcccagctactcaggaggctgaggcaagagaatcgcttaaaccccagaggcagagattgcggtgagccgagatcacgccattgcactccagcctgggccacaagagcgacactccgt

SEQ ID NO: 58476 - DNA, 307 bp, Homo sapiens
  misc_feature 19, 23, 42, 49, 52, 53, 54, 56, 70, 71: n = A,T,C or G
aagagcgccctagcgtttntatnagctgttaggaagattacncatgcangcnnncntcgttccagtgagnncaccctctaaatcaccacgatcaaaagggacaagcatcaagcacgcagcaatgcagctcaaaacgcttagcctagccacacccccacgggaaacagcagtgattaacctttagcaataaacgaaagtttaactaagctatactaaccccagggttggtcaatttcgtgccagccaccgcggtcacacgattaacccaagtcaatagaagccggcgtaaagagtgttttagatcacc

SEQ ID NO: 58477 - DNA, 450 bp, Homo sapiens
  misc_feature 2, 5, 52: n = A,T,C or G
gnccntgaaagctactgtttggaagctaagacttgtatagagtagttttgtntatgaattgttgttctagctcagatttcaggttactcacaacagtattctttctaagaggatatatacaaatgtctctcataatttatgtaaggaaatattatgaaaatgagacttttttagtttgatgtgtgtttcccaaactagagataaaactagtaagatttagtatcgtttataacatttgaatttttgctccatgagtacaactaatttttataagtaaatattgggtttatatgaaaaatggggtgcagtcttttcacacgcccagcaggtaacaatgtgggaagctgcagggtcattgatagcaagtaagacttcctgaagctttccagttcaaaagattacaagccattctgcctgccaaacaaatatattctggaagatcctgttttg

SEQ ID NO: 58478 - DNA, 233 bp, Homo sapiens
  misc_feature 35, 50, 51, 58, 70: n = A,T,C or G
atagtaaacccgaggactacctaaatgcagaatcncgagtgaacagacgnnagatgcntgataacagggngcagtgttgtttatacttcattgctccttcaggacatggacttaaaccattggatattgagtttatgaagcgtttgcatgaaaaagtgaatatcatcccacttattgccaaagcagacacactcacaccagaggaatgccaacagtttaaaaaacagatcacg

SEQ ID NO: 58479 - DNA, 441 bp, Homo sapiens
aacaagtttctattaaaaggcaaatgctgttacaaatttttggcttctggtaatattaaaaccattttagaaatacactctgtgctcactgtgcagaggaacatcagttttcaaaccaacactgaaattctgtggcatcacatatattgggccttgatgtcatgacagatcaaaatcatttgatatccctttctccattctaggtttttctttttttcagtaactgatttaccttgatcacttttcaacttccatattcttcatatagtaaaaggcaaagtattgaagatactacggtgtggtagtagttgaaaattattgccgcattatttacatacttaagacatattagcaagttgatccaaatgggaggccttatagatgtgcctggggggaaaatggaagggggagaaagtagccatacaggagttcaaagaattc

SEQ ID NO: 58480 - DNA, 443 bp, Homo sapiens
  misc_feature 1, 3, 368: n = A,T,C or G
nanctgaccctgttttagaataattttgttattgagcagctgttttatcaccagacctcattcatttattattgcttttttccatttttttttaaatctcatgaactgtattctttcattttaaatctctcatatttgccctgaagtcagtggcatatttggactaatgttttgatttgctgttgtctgcgcaaagatctattaccaagttgcatgatcaagttggtattgaatggtaattcagttaatgtcttcttctctccattccttttttccttctgtattctagaagttaccttaacactagtgtgagatcctgcaaagttaatggggaaatgaaattaaatattactggtatcaaatcctangggggccttttgccacactaatgacatagaaaattttcagcatgaattatgcagcttaaattttcactgaggctg

SEQ ID NO: 58481 - DNA, 141 bp, Homo sapiens
  misc_feature 8: n = A,T,C or G
caatgtanctctttggcaacaggaaacaggttttgcaagttcaaggttcactccctatatgtgattataggaattgtttgggggaaatggattaacatacccgtctatgcctaaaagataataaaactgaaatatgtcttc

SEQ ID NO: 58482 - DNA, 413 bp, Homo sapiens
  misc_feature 2, 4, 27, 46: n = A,T,C or G
tntnctttagtcaggaaggacgttggngttgaggttagcatacgtntcaaggacagtaactaccatggctcccgaagttttgccaaaacctcggatgcgtggccttctggccaggcgtctgcgaaatcatatggctgtagcattccgtgctatccctgggggttgcagctttgtataagtttcgtgtggctgatcaaagaaagaaggcatacgcagatttctacagaaactacgatgtcatgaaagattttgaggagatgaggaaggctggtatctttcagagtgtaaagtaatcttggaatataaagaatttcttcaggttgaattacctagaagtttgcactgacttgtgttcctgaactatgacacatgaatatgtgggctaagaaataggttcctcttgataaataaac

SEQ ID NO: 58483 - DNA, 456 bp, Homo sapiens
  misc_feature 1: n = A,T,C or G
naaatcgcccggttaaaacctgacacttttaccagtgaacagcgttctgagtgtggttgagtagccagtgaagataatgaatgtcgaatgtgactgactagcagcttcattttgaatgagggtcgctgtctgcccattgatagaggccagattgtcttggaagttccaaagttgcaacgatttctggctagtgccacgaggtttacttgactgttgtgtgaaaagctgataagaaaaccatccagaaaaaagctcttcgttttacaaacatgaaaataaaacatttagttgaatccatggacatgaaacccacagatatagagggttgcccggtgcaagtggctcacgcctgtaatcccagcactttgggaggccaaggcgggtgggatcacctgaggtcaagaagcttgagaccagcctggcaacatggtaaaaccccatctttactaataatat

SEQ ID NO: 58484 - DNA, 405 bp, Homo sapiens
  misc_feature 5, 35, 36, 46: n = A,T,C or G
cccgntgctgctgaggagaggagcgtcaacagcannaccatggctnagaaccttgaaggctatgtgggatttgccaatctcccaaatcaagtatacagaaaatcggtgaagagaggttttgaattcacgcttatggtagtgggtgaatctggattgggaaagtcgacattaatcaactcattattcctcacagatttgtattctccagagtatccaggtccttctcatagaattaaaaagactgtacaggtggaacaatccaaagttttaatcaaagaaggtggtgttcagttgctgctcacaatagttgataccccaggatttggagatgcagtggataatagtaattgctgcagcctgttatcgactacattgatagtaaatttgaggactacctaaatgcag

SEQ ID NO: 58485 - DNA, 241 bp, Homo sapiens
  misc_feature 11, 48: n = A,T,C or G
tgatgatgccnagcgtacaggcaggacaagagcgtagcctgctgttgnctccatcactatgaaatgacttattttacctgaaggacccatggtttatgttcctctaattcctttcactctccctaagccctctgagagagatgaagatagatgattttattgctactaaattgaagggagcactatttctttttgtcttttgttagcaaaaaattgcaaaaagaattgtacattcttgcca

SEQ ID NO: 58486 - DNA, 434 bp, Homo sapiens
  misc_feature 2, 39, 40: n = A,T,C or G
angcagacccagcttagagttcttctttctttcttaagnnctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttgggttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttggtactgtgatattttaaatatccacagactcactttttccaaatgatcctagtaattgcctagaaatatcttt

SEQ ID NO: 58487 - DNA, 250 bp, Homo sapiens
  misc_feature 16, 36: n = A,T,C or G
aatgaagcaaatatancatgcatttcacattttgtntttccctgtttcgattttaatagcagaactgtatgacaagtttaggtgatcctagcatatgttaaattcaaattaatgtaaaacagattaacaacaacaaagaaactgtctatttgagtgaagtcatgctttctattataatttggcttcggttatccatcaaatgcacacttatactgttatctgattgtttataataaagaatactgtactt

SEQ ID NO: 58488 - DNA, 391 bp, Homo sapiens
  misc_feature 1, 10, 53: n = A,T,C or G
nacgccagangcgtgaaatggaagagaactttgccgttgaagctgctaactancaagacactattggccgcctgcaggatgagattcagaatatgaaggaggaaatggctcgtcaccttcgtgaataccaagacctgctcaatgttaagatggcccttgacattgagactgccacctacaggaagctgctggaaggcgaggagagcaggatttctctgcctcttccaaacttttcctccctgaacctgagggaaactaatctggattcactccctctggttgatacccactcaaaaaggacacttctgattaagacggttgaaactagagatggcaggttatcaacgaaacttcttagcatcacgatgaccttgaataaaaattgcacaca

SEQ ID NO: 58489 - DNA, 444 bp, Homo sapiens
  misc_feature 2, 27, 47, 439: n = A,T,C or G
anaagagctgaggatggctctgtcatngattatgaactgattgaccntgatgctcgggatctctatgacgctggagtgaagaggaaaggaactgatgttcccaagtggatcagcatcatgaccgagcggagcgtgccccacctccagaaagtatttgataggtacaagagttacagcccttatgacatgttggaaagcatcaggaaagaggttaaaggagacctggaaaatgctttcctgaacctggttcagtgcattcagaacaagcccctgtattttgctgatcggctgtatgactccatgaagggcaaggggccgcgagataaggcctgatcagaatcatggtctcccgcagtgaagtggacatgttgaaaattaggtctgaatcaagagaaagtacggcaagtccctgtactattatatccagcaagacactaangggcg

SEQ ID NO: 58490 - DNA, 168 bp, Homo sapiens
  misc_feature 11, 39, 48: n = A,T,C or G
tcctttgatgncctgcaggggtggctaatgtgctggggnttttctgtnttaatagtcacagtattgttttattggtgaatagctgaaaaacagagggattaagtcatattccgggaaagagaattatagtttttatgcctcctgttgaataaatggtgtcctgattgc

SEQ ID NO: 58491 - DNA, 451 bp, Homo sapiens
  misc_feature 3, 16, 27, 30, 32: n = A,T,C or G
aanagaaccctttgcnagaaaaaactncgngngtactttccccatcttcccaagatttagattctaggatctgaaggagaacctgcatttagatttcttgtcgattcttcaaagaaggaaccaaggtggaatttttggaagtatcttgtcaaccctgagggtcaagttgtgaagttctggaggccagaggagcccattgaagtcatcaggcctgacatagcagctctggttagacaagtgatcacaaaaaagaaagaggatctatgagaacgccattgcgtttctaatagaacagagaaatgtctccatgagggtttggtctcattttaaacattttttttggagacagtgctcactctgcacccaggctggagtgcagtagtgcgtctcagctcattgcaacctctgcctttttaaacatgctattaaatgtggcaatgaaggatttttt

SEQ ID NO: 58492 - DNA, 260 bp, Homo sapiens
  misc_feature 5, 16: n = A,T,C or G
tagangatgacaaatnagaaaaaagagaaagaggaagctgaacggatgcttcaagacgatgatgatactgtgcaccttccatttgaagggggaagtctcttgcaaattccagtcaaggccctaaaatatagtgttgatccctcaattgttaacatatcagatgaaatggccaaaactgcacagtggaaggcactttccatgaatactgagaatgccaaagtaaccagatctaacatgagtcctgataaacctgtgagtgc

SEQ ID NO: 58493 - DNA, 444 bp, Homo sapiens
  misc_feature 2, 11, 46, 57, 73, 400, 411, 416: n = A,T,C or G
gngaacatgtntgagtcggagctcggcaggaagtgggaccggtgtntggcggacgcnggtcgtgaagataggnactggttttggattaggaattgttttctcacttaccttctttaaaagaagaatgtggccattagccttcggttctggcatgggattaggaatggcttattccaactgtcagcatgatttccaggctccatatcttctacatggaaaatatgtcaaagagcaggagcagtgacttcacctgagaacatcccagcgggaggacaagagaaatcatgtttattcctcaggaatactgaagtgccctggagtaaagctgccattcttctgtaacaatgttatcaagtaatgctttaaactccagcacctggttatgcatttgaaaccaagnctggttcttgntttgnattttctctctggaagttgtaaaggagg

SEQ ID NO: 58494 - DNA, 351 bp, Homo sapiens
  misc_feature 7, 8, 30, 34, 40, 44, 52, 57, 69, 350: n = A,T,C or G
gcacagnntacgctgaggtctataagatgntgangacatnacantggatggncaggngatgataattgngcctccaagaacaatttatgaaaaccaaatatacagccttaaaatagaatgtggacctaaatacccactagcacccccctttgtaagatttgtaacaaaaattaatgtaaatggagttaatagttctaatggagtagtggacccaagagccatatcagtgctagcaaaatggcagaattcatatagcatcaaagttgtcctgcaagagcttcagtgcctattgatgtctaaagaaaatatgaaactccctcagccaccggaggacagtgttacagcaattna

SEQ ID NO: 58495 - DNA, 419 bp, Homo sapiens
  misc_feature 22, 25: n = A,T,C or G
tcagatattgccaagattatantanaggcatccttctagtatggagtaaggcacctcccaggtaatggggaatgagtctgaaaacgatttattcaaggcagctggttatttatgatgtcaagccatacctactgtcttctaaaagggtctacggctggagaagagactgcctagtgtcaaccaaataagatgatcatggcaagagaaaacctcattagaactcagcaatgtgactttttaaagaatgttctaaattgcctataacagtataagggtttcaaagttctggggtgaaaacactgtctccagcatgagctctcttcaactacttgagaagaaatgcacctcaccttgagttgactcaagtcctacagccactggtaacacgttaaatgagcccttgccttgaagagagcaat

SEQ ID NO: 58496 - DNA, 367 bp, Homo sapiens
  misc_feature 2, 17, 57: n = A,T,C or G
gnaaggtcccttatttngcaacctagaccttaaccttgattttattatttcatagtntctgatcttcactggcatactgggttcctcggaaaagtggaagacatgaagtatggatgtatataatacccgaggaagtctcaaaggtactatgaaatatgtctaaacgtgaaaggtgcccgagagaacttgagtcaccaagatcagcctctgaccaacttctttaatgcagagaaggttgtgtgtggtgcattgtgtgggaggcagaatttagccctaggtgtaactgttcaaaggacaagtatgagtatcctaaacctactctacaaaaataataaccattaacattttggtctgtctacctacctag

SEQ ID NO: 58497 - DNA, 439 bp, Homo sapiens
  misc_feature 25, 31, 33, 34, 35, 36, 37, 38, 43, 50, 53, 80: n = A,T,C or G
gcaagtgaatacttcagacgacttnaggatngnnnnnnctggntttgccnctnatgctctgcgacttgcaggcactgggnagattcgtagctaagacgccaggggcatcccggaagctgggaaatgggactgttgacattcagggatgtgcccgtagaattctctttggaggagtgggaacacctggaaccagctcagaagaatttgtatcaggatgtgatgttagaaaactacagaaacctggctctctgggtcttgttgtctctaagccggacctgatcacctttttggaacaaaggaaagagccttggaatgtgaagagtgaggagacagtagccatccagccagatgtgttttcgcattataacaaggacctgttgcagagcactgcacagaagcttcattccaaaaagtgatatcgaggagacatgggagctgt

SEQ ID NO: 58498 - DNA, 260 bp, Homo sapiens
  misc_feature 4, 9, 28, 53, 228, 250: n = A,T,C or G
cgtngggtntgtaaagtgaaagaaggcntgaatattgtggttccatggagcgntttgggtccaggaatggcaagaccagcaagaagatcaccattgctgactgtggacaactcgaataagtttgacttgtgttttatcttaaccaccagatcattccttctgtagctcaggagacaccccttcaccccatttgctcgcagtatcctagaatctttgtgctctcgctgnaggtccctttggggtccatgtntttcttgttc

SEQ ID NO: 58499 - DNA, 100 bp, Homo sapiens
  misc_feature 5, 12, 35, 36, 43, 46, 49, 68: n = A,T,C or G
tcacngagaagntgagagaccaccctgagttaaanngataccnttnatnaatattagccgagcaaaantgtcccttgaaactgagagaatgggttgaaat

SEQ ID NO: 58500 - DNA, 391 bp, Homo sapiens
  misc_feature 3, 4, 379, 388: n = A,T,C or G
gtnntactgccgagacccatgtgttcacagtggaagattttgatgcttttcagaggatatcttttgaactcacacagtctatctgccttagaattgagcaagaattggcagctataaagaagaaagcttacgtccctccaaaggatcttagtttttcagaagtgacttcttatggtttcaaaaccaactggtctccagctggagaaaatgttttttcatatcacatcacctacaaggaagcggctggggatgatgaggtcactgtggtggagccagcatcgagcaccagtgttgttctcagcagcctgaagccagagaccttgtatttggcaatgtgactgcggagtatgaggatggcttcagcattcccttagctggngaggagccnccg

SEQ ID NO: 58501 - DNA, 336 bp, Homo sapiens
  misc_feature 23, 51, 54: n = A,T,C or G
taaagtcccatataagtagagtncttggtactctgccctcctgtcagtagnggnagtatctattggcatattcgggagcttcttagagggatgaggttctttgaacacagtgaaaatttaaattagtaacttttttgcaagcagtttattgactgttattgctaagaagaagtaggaaagaaaaagcctgttggcaatcttggttatttctttaagatttctggcagtgtgggatggatgaatgaagtggaatgtgaactttgggcaagttaaatgggacagccttccatgttcatttgtctacctcttaactgaataaaaaagcctacagttttt

SEQ ID NO: 58502 - DNA, 453 bp, Homo sapiens
  misc_feature 1, 7, 372, 377: n = A,T,C or G
naacagnccaaataacccgtattttccagtcttcgttgtgtgaagctaaatggtggctaaaaggaacactttttgtgtgattattataaactttgcattgtatttgaatcttagaacttttgtacacactaaatattgatgtcacaccatttctaatctgagcatccttagccagagaatattcattatacttcctaagtgagcaataatttaaatcagaagctattttattttaatgtaattaacctttctttacatttcttatgtgttcacctctaatctgttttaggaagagagttggtattatgttgatcccataatataaatcatatcctttatattttagaatatctcaaatgtattcctttttgnatggnggggttgcctagggacgtgtactcaggcttttactaagccaaggaaaaagagaattttcttttcatcttacaaatt

SEQ ID NO: 58503 - DNA, 171 bp, Homo sapiens
  misc_feature 15, 28, 37, 49, 55, 63: n = A,T,C or G
aaaaagtcccataantacatctgtgatntctgaactnatggtgctaatncagagnaatggaangtgaaagtgagattctctgttgtcatcggcattccaactttttctctttgtttttgtccagtgttgcatttgaatatgtctgtttctataaataaattttttaagaat

SEQ ID NO: 58504 - DNA, 458 bp, Homo sapiens
  misc_feature 1, 5, 52: n = A,T,C or G
ntccnattactttatcaaccacctgtattgtttccctcttgtaaaagtaccntcaagtggggaaaatgtatgtggaagtggagagtgaatttgtatgactaaaggataatctgtacatggggaagtgggcaaaagtggataggatgaatttaaagaaaatgactacctttggaaaaaagaaattaaattttgttcacatatcctaccctttcccattgtgcatatcccaagtgtcatatttaaaactaaggttacttaaaacagaatccaggaatatcaaggctctgtggcttggaattttagaggataggactaataaaaggcttttgcaaagaaggcttttttccacgttcactttgttttgtgttctttgaaagtaactgatcttttcgggtaggtaattcagcagtccataaatatgatccagtacttgcttatatttattgaagtctcgacag

SEQ ID NO: 58505 - DNA, 368 bp, Homo sapiens
  misc_feature 5, 11, 56, 75, 367: n = A,T,C or G
aaagncccgancttgtcgccgtgtgatgcttgcttgtgagtgtctatagggtgatnctgtagggtggagaaaggncctggtccgcgccagagcccagcgcgcctcgtcgccatgcctcggaaaattgaggaaatcaaggacttcctgctcacagcccgacgaaaggatgccaaatctgtcaagatcaagaaaaataaggacaacgtgaagtttaaagttcgatgcagcagatacctttacaccctggtcatcactgacaaagagaaggcagagaaactgaagcagtcctgcccccggtttggcagtgaaggaactgaaatgaccagacacactgattggactgtattatattaaaatacttaaaatnc

SEQ ID NO: 58506 - DNA, 447 bp, Homo sapiens
  misc_feature 3, 11, 217, 219, 222, 303, 385, 419, 447: n = A,T,C or G
aangttcttgntgcagagtgtatcatgtggaatatcctcatatttttaccatattttaagaactttaagacgattaattgtaaataatttatttgattggtgcagttctaatccctaaatcataatcttaaaatcaggaatgtgtggagaacagagccatgtcatatcactttgctcttaccattccttttgatcagcctcaattcagcctcattgngnagnatgttttttctttctatgaaaaacaacagaaagcatttcattttatttgctatggtcaaatatgtttaataatgccaaagngcattctgagtttttcaagggatgtaatactggagccttaaagaacatacctaggttctcatggggaaaacttaggccttgnccggaaggttttccttcccctatggctaatgtgngggtggttttaaggaattatgttttatn

SEQ ID NO: 58507 - DNA, 319 bp, Homo sapiens
  misc_feature 2, 12, 32, 36, 37, 41, 48, 52, 54, 81, 157: n = A,T,C or G
angatcccttanggagggtagcaaatgacgtncagnngccnttgtgancttntnttactgagttaagatttaactgtattnattagaaaaataatcaggcttattttgaacactgagttgtcactatttttaggtccttactgcacactgaagtatngtacacaagaagctcattatttaagtgatctttacgtggcatacacaaatgtattacctgtaaaattaattttagttaaaaagtgtctgaaaggagatggttactttgtgagtttttttgtttttgggtattagatcttgatgagcccgaaggggtcggatg

SEQ ID NO: 58508 - DNA, 364 bp, Homo sapiens
  misc_feature 10, 15: n = A,T,C or G
aaggactttncgganacagtgtgtaccattccgacgttacaatggtggagttggcatggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcattgagcatatccaagtgaacaaagcacctaagatgcgccgccggacctacagagctcatggtcggattaacccatacatgagctctcctgccacattgagatgatccttacggaaaaggaacagattgtcctaaaccagaagaggaggttgcccagaagaaaaagatatccc

SEQ ID NO: 58509 - DNA, 193 bp, Homo sapiens
  misc_feature 57: n = A,T,C or G
taaagatcccgaagaaactgggagagatgtggaataacactgctgcagatgacaagnttgccttatgaaaagaaggctgcgaagctgaaggaaaaatacgaaaaggatattgctgcatatcgagctaaaggaaagcctgatgcagcaaaaaagggagttgtcaaggctgaaaaaagcaagaaaaagaaggaag

SEQ ID NO: 58510 - DNA, 389 bp, Homo sapiens
  misc_feature 199, 247, 290, 347, 353, 355, 389: n = A,T,C or G
tcaatcaacttgagaagtttgacataaagagcttctgcaagatcctggggccattatcctactccaagatcaagcatttgcgtttggatggcaatcgcatctcagaaaccagtcttccaccggatatgtatgaatgtctacgtgttgctaacgaagcactcttaattaatatctgtatcctggaacaatattttatggntatgtttttctgtggtcagttttcatagtatccatattttattactgnttattacttccatgaattttaaaatctgagggaaatgttttgnaaacatttattttttttaaagaaaagatgaaaggcaggcctattcatcacaagaacncacacntntccacgaatggcatcaactcaatgcttatttggn

SEQ ID NO: 58511 - DNA, 472 bp, Homo sapiens
  misc_feature 7, 442: n = A,T,C or G
aaagaanccggcggacattcagactgagcgtgcctaccaaaagcagccgaccatctttcaaaacaagaagagggtcctgctgggagaaactggcaaggagaagctcccgcggtactacaagaacatcggtctgggcttcaagacacccaaggaggctattgagggcacctacattgacaagaaatgccccttcactggtaatgtgtccattcgagggcggatcctctctggcgtggtgaccaagatgaagatgcagaggaccattgtcatccgccgagactatctgcactacatccgcaagtacaaccgcttcgagaagcgccacaagaacatgtctgtacacctgtcccctgcttcagggacgtccagatcggtgacatcgtcacaagtgggcgaagtgccggcctcttgagcaagacaagtgcgcttcaacgtgctcaangtcaccaaggcttgccggcaccaagaaagc

SEQ ID NO: 58512 - DNA, 248 bp, Homo sapiens
  misc_feature 1, 18: n = A,T,C or G
naacacatggatctgggnatcaaatatgacccaagcattggtatctacggcctggacttctatgtggtgctgggtaggccaggtttcagcatcgcagacaagaagcgcaggacaggctgcattggggccaaacacagaatcagcaaagaggaggccatgcgctggtaccagcagaagtatgatgggatcatccttcctggcaaataaattcccgtttctatccaaaagagcaataaaaagtttcaggg

SEQ ID NO: 58513 - DNA, 251 bp, Homo sapiens
  misc_feature 14, 34, 37, 53, 187, 210, 224, 249: n = A,T,C or G
aaatatccacagtnctcactttttccaaatgatnctngtaattgcctagaaanatctttctcttacctgttatttatcaatttttcccagtatttttatacggaaaaaattgtattgaaaacacttagtatgcagttgataagaggaatttggtataattatggtgggtgattattttttatactgnatgtgccaaagctttactactgnggaaagacaactgntttaataaaagatttacattccacngg

SEQ ID NO: 58514 - DNA, 385 bp, Homo sapiens
  misc_feature 4, 45: n = A,T,C or G
aaancaaaacatttggcaagatacagtactacacaatttggagancacttggctcccatagaaatcaaagccttcctgagtaattaattatttggcctgatgatgaattactgtgcctgagatgatagagctaatttatttttcaattcactcaggggacacacgttattttcactgtgaatttggttaaaatgaaaagatttcctgctctaagtcctggatagacctttatgtaatagcatactcttcactctttttgaatcgcatgcagttgcagactggatgatttccagacagaggtccaagctttcatcatgtttgggggtaaagacctcattaacatactagtcctgccatttgagtctggtctcttcacggaatattt

SEQ ID NO: 58515 - DNA, 124 bp, Homo sapiens
  misc_feature 2, 44: n = A,T,C or G
tntaactccaccattagcacccaaagctaagattctaatttaanctattctctgttctttcatggggaagcagatttgggtaccacccaagtattgactcacccatcaacaaccgctatgtatc

SEQ ID NO: 58516 - DNA, 443 bp, Homo sapiens
  misc_feature 17, 39, 51, 55, 327: n = A,T,C or G
actgaggaagcactgcnataagctgagctggagtgtagnagctcgactgtntttnaggagcaagactggtgccccttgccagatctgagcgcttggcaagtacaaccagctcctcagaattgaagaggagctgggcagcaaggctaagtttgccggcaggaacttcagaaaccccttggccaagtaagctgtgggcaggcaagcccttcggtcacctgttggctacacagacccctcccctcgtgtcagctcaggcaagctcgaggccccgaccaacacttgcaggggtcctgtagttagcgcccaccgccgtggagttcgtaccgnttccttagaacttctacagaagccaagctcctggagcctgttggcagctttagctttgcagtcgtgtaattggccaagtcattgttttctcgcctactttcaccaagtgtctagag

SEQ ID NO: 58517 - DNA, 342 bp, Homo sapiens
  misc_feature 4, 7, 36: n = A,T,C or G
gaancgnccaatgtgtagaaatgcgacattctgagngcttgttgaaaacattcaggctctacccaattattctaagacctgtgaacaagtaaactctacttagtaacacaaacctcactctctactttttaagcctcactttaacatatagattgctaagtatcccagggaatttgagaaattcctttaatgtaagacaaaggaaaatgggaaaatcaggaataataactcagaagaaattgaaacattcacaatacagttagcaaaagaaaaactttttaaaaagcaataactgatatgctcagaggaaaaataaaagacacaggaaagatgaataggatg

SEQ ID NO: 58518 - DNA, 448 bp, Homo sapiens
  misc_feature 20, 28, 29, 33, 39, 62, 435: n = A,T,C or G
taaaaaaccccgagggctangtatgtgnnaggntggtgntcaggtaacagccaagatgcttntggaatctgctggctcttcgtcagattgggcagaggacgataagcactgcttcccgcaggcattttaaaaataaagttccggagaagcaaaaactgttccaggaggatgatgaaattccactgtatctaaagggtggggtagctgatgccctcctgtatagagccaccatgattcttacagttggtggaacagcatatgccatatatgagctggctgtggcttcatttcccaagaagcaggagtgacttcagtcatcccagcaatcgcttggttcaagtttcattcagctctctatggaccagtaatctgataaataaccgagctcttctttggggatcaatatttattgacttgtagtaactgccaccaatnaagcagctttacc

SEQ ID NO: 58519 - DNA, 425 bp, Homo sapiens
  misc_feature 4, 17, 30, 328: n = A,T,C or G
attnacccaaataaagnataggcgatttanattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttatagatagaggcgacaaacctaccgagcctggtgatagctggttgtccaagatagaatcttagttcaactttaaatntgcccacagaaccctctaaatccccttgtaaatttaactgttagtccaaagaggaacagctctttggacactaggaaaaaaccttgtagagagagta

SEQ ID NO: 58520 - DNA, 238 bp, Homo sapiens
  misc_feature 10, 15, 34: n = A,T,C or G
tccctatgtntgagnttttggtctaatctgtgtngaccagtgcaacgtgacccgacaaaattccagttatttatttccaaaatgtttggaaacagtataatttgacaaagaaaaatgatacttctctttttttactgtgccaccaaatacaattcaaatgctttttgttttatttttttaccaattccaatttcaaaatgtctcaatggtgctataataaataaacttcaacactctt

SEQ ID NO: 58521 - DNA, 200 bp, Homo sapiens
  misc_feature 5, 35, 51, 55, 57, 69: n = A,T,C or G
tattntgccgttgtagaagaaataaataagcaaanttgtggtattcttttntttnancctgctctcatncctattaacactaagatcttagatttttatagtgataaatgggttgacatcatttgtcgtttgtaattgtaaagcctcaaaagacaactgttcctactatgtaattatagacagaaataaaaacttcagat

SEQ ID NO: 58522 - DNA, 342 bp, Homo sapiens
  misc_feature 6, 17, 28, 32, 38, 86, 316, 319: n = A,T,C or G
ctgaangttatgcctgntgcaggctaangtanagtgtnttaaataatgcaaatgtgcacggctactctatatacttttgcttggcncattttttttcccttttagttaagcatgactttagatgggaagcctgtgtatcgtggagaaacaagagaccaactttttcattccctgcccccaatttcccagactagatttcaagctaattttctttttctgaagcctctaacaaatgatctagttcagaaggaagcaaaatcccttaatctatgtgcaccgttgggaccaatgccttaattaaagaatttaaaaaagntgnaataggagaatatttttggcatc

SEQ ID NO: 58523 - DNA, 452 bp, Homo sapiens
  misc_feature 2, 3, 32, 39, 55: n = A,T,C or G
annaaggttccccgagcagcgcgtttacaagngctgccnaacaagatgcccttgngagctgtgagggaaagaggacctgcgggcttagatcaatctcaattccttttcatgccctcctgcattgctgctgcgtgggtatttgtctccttagccatcaggtacagtttacactacaatgtaagctataggtggagcatcagcagtgagtgaggccattcttcatccttaggatgtggcaatgaaatgatggtgcaagttcctttctcttttgtgaatctttccccccatttcctgtttacatgtaacccaacaaaatgcaatttctaggccttctgtccaatcagttctttcctctgagtgagacgtacttggctacagatttctgccttgttttgcgacattgtcccattcacacagatattttgggataataaaggaaaataaggctacag

SEQ ID NO: 58524 - DNA, 254 bp, Homo sapiens
  misc_feature 2, 13, 61, 65, 68, 71: n = A,T,C or G
tnaatatcccatntgtcgttgagcggggggtttggtttgctttggtttatattttttcagntgtntgnttntgcttgttatattaagcagaaatcctgcaatgaaaggtactatatttgctagactctagacaagatattgtacataaaagaatttttttgtctttaaatagatacaaatgtctatcaactttaatcaagttgtaacttatattgaagacaatttgatacataataaaaaattatgacaatgcc

SEQ ID NO: 58525 - DNA, 451 bp, Homo sapiens
  misc_feature 3, 351: n = A,T,C or G
aancgatcccgtggctttgaagaactttgccaaatactttcttcaccaatctcatgtttgagagggaacatgctgagaaactgatgaagctgcagaaccaacgaggtggccgaatcttccttcaggatatcaagaaaccagactgtgatgactgggagagcgggctgaatgcaatggagtgtgcattacatttggaaaaaaatgtgaatcagtcactactggaactgcacaaactggccactgacaaaaatgacccccatttgtgtgacttcattgagacacattacctgaatgagcaggtgaaagccatcaaagaattgggtgaccacgtgaccaacttgcgcaagatgngagcgcccgaatctggcttgcggaatatctctttgacaagcacaccctgggagacagtgataatgaaagctaagcctcggctaatttccccatagccgtg

SEQ ID NO: 58526 - DNA, 152 bp, Homo sapiens
  misc_feature 1, 5: n = A,T,C or G
ntganggaactgaatcgatacggtgttttctgtccctcctactttccttcacaccagacagcccctcatgtctccaggacaggacaggactacagacaactctttctttaaataaattaagtctctacaataaaaacacaactgcaaagtac

SEQ ID NO: 58527 - DNA, 171 bp, Homo sapiens
  misc_feature 6, 15, 27, 30, 33, 39, 117: n = A,T,C or G
gcaacntcgcagagnatacaaagacancangtntttgtnaggaagcaaagtcataatgaaaatggtaagtgctggataattagagtgaagatgggtagaaaatataaagaacttganttcttctgtatattgacgtcttcttacgatttcaagatgtggtcagattgtttc

SEQ ID NO: 58528 - DNA, 232 bp, Homo sapiens
  misc_feature 3: n = A,T,C or G
aangtgacaagttaaaatggtgcattatgtatatatattataatttagaaataccattttataattttactattccagggtgacataatgcatttaaatttgggatttgggtggagtattatgtttaactggagttgtcaagtatgagtccctcaggaaaaaaaaaaaatctgttttaaaaagcaacctgattcttagctcttgaaactattgctcttaaattccaataatt

SEQ ID NO: 58529 - DNA, 436 bp, Homo sapiens
  misc_feature 32, 35, 176, 225, 328: n = A,T,C or G
gcaagaagaccacttaagacgactttagaccntgntcctctggatttgttcctcatttgtcacaggtgtcttgtgattgaaaatcatgagcgaagtgaaattgcattgaatttcaagggaatttagtatgtaaatcgtgccttagaaacacatctgttgtcttttctgtgtttggncgatattaataatggcaaaatttttgcctatctagtatcttcaaattgnagtctttgtaacaaccaaataaccttttgtggtcactgtaaaattaatatttggtagacagaatccatgtacctttgctaaggtagaatgaataatttattgnatttttaatttgaatggttgtgccttttaaatgagccaagctagagggggaactatccctaaaatcagttggaaaacaagacctaaaaaggggaaggggatggggatt

SEQ ID NO: 58530 - DNA, 327 bp, Homo sapiens
  misc_feature 7, 27, 29, 32, 33, 34, 45, 49, 52, 59, 61, 65, 67, 69, 72,79, 86, 88, 140, 309, 311, 321: n = A,T,C or G
cccgatncattctaaaacttgtatttncnagnnnttataaaaganatgnctngagactnantctngnanganacgattntgcccantnttaagtaaaaaatataagaaaaggttatcttaaatagatcttaggcaaaatnccagctgatgaaggcatcttgatgccttcatctgttcagtcatctccaaaaacagtaaaaataaccactttttgttgggcaatatgaaatttttaaaggacgtagaataccaaatgatagaaacagactgcctgaatcgcgcttttgatttcttaaagtgtgttccttncnaaattgctgntcctta

SEQ ID NO: 58531 - DNA, 452 bp, Homo sapiens
  misc_feature 6, 11, 56, 57: n = A,T,C or G
aagganccganaaaaaaagtaaaaggaactcggcaaatcttaccccgcctgttttnnaaaaacatcacctctagcatcaccagtattagaggcaccgcctgcccagtgacacatgtttaacggccgcggtaccctaaccgtgcaaaggtagcataatcacttgttccttaaatagggacctgtatgaatagctccacgagggttcagctgtctcttacttttaaccagtgaaattgacctgcccgtgaagaggcgggcataacacagcaagacgagaagaccctatggagctttaatttattaatgcaaacagtacctaacaaacccacaggtcctaaactaccaaacctgcattaaaaatttcggttggggcgacctcggagcagaacccaacctccgagcagtacatgctaagacttcaccagtcaaagcgaactactatactcaattga

SEQ ID NO: 58532 - DNA, 382 bp, Homo sapiens
  misc_feature 8, 27: n = A,T,C or G
gcaccttnggtcatcggggggcgctgnccaggaattctttgtggacattggcccagtctgtttcaaataaatgaactcaatctaaattaaaaaagaaagaaatttgaaaaaactttctctttgccatttcttcttcttcttttttaactgaaagctgaatccttccatttcttctgcacatctacttgcttaaattgtgggcaaaagagaaaaagaaggattgatcagagcattgtgcaatacagtttcattaactccttccctcgctcccccaaaaatttgaatttttttttcaacactcttacacctgttatggaaaatgcaacctttgtaagaaaaccaaaataaaaattgaaaaataaaaaccataaacatttgcacc

SEQ ID NO: 58533 - DNA, 445 bp, Homo sapiens
  misc_feature 14, 49, 353, 376: n = A,T,C or G
cccaaaaagctggnggctctgccccgtattatggagatgaaccaatggntttcaaaatcaacaccgatgagattatgacttcactcaagtctgttaatggacaaatagaaagcctcattagtcctgatggttctcgtaaaaaccccgctagaaactgcagagacctgaaattctgccatcctgaactcaagagtggagaatactgggttgaccctaaccaaggatgcaaattggatgctatcaaggtattctgtaatatggaaactggggaaacatgcataagtgccaatcctttgaatgttccacggaaacactggtggcagattctagtgctgagaagaaacacgtttggnttggagagtccatggatggtggntttcaggttagctacggcaatcctgaacttcctgaagatgtccttgatgtgcagctggcattccttcga

SEQ ID NO: 58534 - DNA, 447 bp, Homo sapiens
  misc_feature 3, 33, 55, 56: n = A,T,C or G
ganaggcccattccagaaatgctaggatggatngatattttaaaaaaatatgttnntataatttatcatattactaggtgagggagatacagtttcttgatgtattctagaaagacattttattacatccaggctacattcttgatttaaaaacaaagtttactaaattccaagcagtataatattttaataacaaaataaagaacatctatttgaaatttagtggccaccatagattgacagtagaacaataaaacatttattttcattgacaacaggaattgggtgaagatgcttctcaccaacactttagaagtctataaaataaatgtaaaaaaagaataaattacattataatgagccatgcatgtcttagtccattcctgctcccataacaggatctgtagactgagaaatttattaacaacagaaattggttctcacagt

SEQ ID NO: 58535 - DNA, 219 bp, Homo sapiens
  misc_feature 4, 13, 32, 36, 44, 51: n = A,T,C or G
aagncggctggcnaagatgtcaatgttacttntcgnagatcagncaaaagntaaacaaatttgcacggaatacaagtagaatcacagagctgaaggaagaaatagaagtaaaaaagaaacaactccaaaacctagaagatgcttgtgatgacatcatgcttgcagatgatgattgcttaatgataccttatcaaattggtgatgtcttcattagccatt

SEQ ID NO: 58536 - DNA, 116 bp, Homo sapiens
aattcagaggagtatgtgataacacctctaggtaagcactgagacacacaagaggagaattgtgctatgtctgtccagggggtatataattcaattaatggtggcttccattaatt

SEQ ID NO: 58537 - DNA, 349 bp, Homo sapiens
atggccggggattaaattaaatttcagaggaagtaatgtgataaacacctttaggtaaagcactgagacacaaaaagaagaaaatggctatgctgtcagggagtatataaatcaataatggtagcttccatttattgagtcctaactatggtattggcactgttcatatagtatgccatttaacactcatagcaacccagtgaagtaggtgttataacccctagtttaagaatgaaattaagtaacttaaacaagttcatagaataaataataggattcaaacttaggtccctccagtttccaagcctgtgctctttcactatacatgatgtcagctgggatctagccc

SEQ ID NO: 58538 - DNA, 145 bp, Homo sapiens
ggcaagcgaaattggtcattctcgctaacaactgcccacctttgaggaaatctgaaatagagtactatgctatgttggctaaaactggtgtccatcactcacagtggcattaatattgacctgggcacagcatgcggaaattact

SEQ ID NO: 58539 - DNA, 177 bp, Homo sapiens
aagtcataaagttgttgaattacaatccaagttagcagtactaaatgagagaccaataatacattgggatgaaaaggcacattcacctgatactgcagagattcaaaggatattagcggctactatcagtagtgaaatattgttaaagtcagagttgttaaaatgtgctatactacc

SEQ ID NO: 58540 - DNA, 324 bp, Homo sapiens
atggccgggataacacaaaagatcaataaaaaagttgtgttttgaaaatttaaccaaattcacaaagctttagtcagattaactaaaaaatgagagaaccaaataaataaaattggagatgaaaaaggacacattacaactgatactgcagaaattcaaaggattattagcggctactatcagtagtgaaatattgttaaagtcagtgttgttaaaatgtgcatactaccaaaattatttgaataactatttgccaatgaattgccaaatctagaagaaatggtcaaattcctagacacatactacctacaaagatagagccaa

SEQ ID NO: 58541 - DNA, 109 bp, Homo sapiens
tgatatatgaacagcagtcatatctggcaggaatgtgttaggagatatacactcatgctccgtcaggaacatcatatgtctaccccggtctacggtatctatctcctgg

SEQ ID NO: 58542 - DNA, 459 bp, Homo sapiens
atggccggggatacttgtatatatggaaaacaagcaagtttatatttttggacagggaaatgtgtgtaagaaagtatattaacaaatcaatgcctccgtcaagcaaacaatcatatgtatactttttttctacgttatctcatctccttgttttcagtgtgcttcaataatgcaggttaatattaaagatggaaattaagcaattatttatgaatttgtgcaatgttagattttcttatcaatcaagttctcgaatttgattctaagttgcatattataacagtctcgaaaattattttacttgcccaacaaatattacttttttcctttcaagataattttataaatcatttgacctacctaattgctaaatgaataacatatggggggcctgttattaagagtggttggtttaagtcattcaaggaaaaatccaaactttttttcccaccaaaggga

SEQ ID NO: 58543 - DNA, 133 bp, Homo sapiens
atataattctacaactatatgagacagacaatcttaggatatagacaggaacctggactctacagcacaggtgaggcaacagcgaggctatgagatagcaggacacagcaatctaaacagcctctggcctgaa

SEQ ID NO: 58544 - DNA, 393 bp, Homo sapiens
atggccggggtttagacttcatttatattttccttactaatatctaatatttaatgaataatgatcaattttttataaagttattaatatgatcagggaaacctttgggacttctgacaggcatctggtgaagagacaattcaagccttagtgactatttagaatagccagtgatcactagctaattctcatatccatgcctttttgtcctgtttacagtcttaaaagaggtaaaacagcaaatatttttttaagggaactataaccttaggattcctgaaaagaatttcaaaaaaaaaataaagacactgttgccaatgtgacccaaaacttaagaacatactaatggcatatatttgttacaattaaaaaataaatttactacttaatcct

SEQ ID NO: 58545 - DNA, 176 bp, Homo sapiens
gacaaaaatatagaagttattggatcatgaatttaacataaatcttcagatagagatgaggttctggaatggtagtatgagtcacttacaaacacgcaaggagagatatataattcaacaatgtaattggacaattcaataccctacttgcaataatggatagaagagctaggcat

SEQ ID NO: 58546 - DNA, 641 bp, Homo sapiens
atggccggggacacaagaacacagaaataataagaaaaaggttaattggacttcattgaaattataaacataaaatcttcaagaatagaagatgaggtttctggaatggtagtatgagtcactgacagaaacgaaaggagagataaataattcaacaatgtaattggacacttcaataccctacttgcaataatggatagaagagctaggcataaaatcaagaaggataggaagacatgaaaacctcggaaaactataaatcaaagacacctaacagatatctattcagtactttatccaacaacagcagaatacccattcttctcaagcacacacgggacattctgtaggacagaccatatggtaggccacaagggaagcttcaatgaattgaaaaggatttaaataatataaagtatgtcctctgatcagaaataacagaagaaaatttagggaatcataaatatatgggaattaaaggacacatttctaaataactaatgggtcaataataaatcacaagggaaattaggaaatgttttggaatggataaacacaaaatacaggatactaacattttatatggtacaactaaaggtaatggttacagggaaatttataactaaatgcctaatgtttaa

SEQ ID NO: 58547 - DNA, 136 bp, Homo sapiens
acaatgaatacaggaagataagtgttcgttcttttctgaaaaagagtatgtttaccacaagagcttgttttaatttgggtgaattgttttttgtgctcatatctgtacagacaatttgtatatatagatggggtct

SEQ ID NO: 58548 - DNA, 115 bp, Homo sapiens
tatgtgagcaaatagggtgtgcagaggagagacagaaaggattttgatattgaatagatagggtggagttggatttttggagggcctgaaaattttaaggtttatatgacaaaaa

SEQ ID NO: 58549 - DNA, 362 bp, Homo sapiens
tatggccggggtaattaaatatgtgagcaaaatagggtgtgcagaggagagcacagaaaggaatctgatattgaatagatagggtgggattggatttttggagggccttgaaaattctaggctttatatgacagaaagtaggtcatcatctcaggttcttggcagagaggtgacatgacgaaagtattgttttggattaggcaagcagtatcacaggatggattagagaaaagatcattaaaggcccctggggagggaagaaggacagctaggagacacttaaattttagaggcttaggcaggagattgccaaggtctcagaggaggatgagaggagtgaagaaggggtgaataaggccatg

SEQ ID NO: 58550 - DNA, 285 bp, Homo sapiens
gaagtgatatgtagcacagggatggtctgtcaaaggatgccacagtgtacatggcaaactggagagtctcatgttaccagcatgctgttggcatagtggtaacaaccaggttaagggcaggatccttgccacgagaattaatgtgcgtattgggcacattaagcactctagagccgcgttagcttcctgaaacgcgtgaagggaaatgatcagaaaaagaaagaggccaaagagaaaggtcctcggttcacctaaagagccacctcctccccccgggaggccccc

SEQ ID NO: 58551 - DNA, 327 bp, Homo sapiens
gaacactttcaccattacaggccatgctgagacaaggcagctgacagaattgttacccagcatcttaaaccagcttggtgcggttagtctgactagtttaaggggactggccgaagctcttcccaacacaatctgtggatggaaaagacaccacttgcttacttggagaggatgatgattgatgaaggttcccagatcttgttggagaattttgatgaggcttccaagaattagggcaaacttaattgagtcaacttcttaaggttaaaaccctaagggaggtactgggagctctctattttatatatagtactctcttttaaggga

SEQ ID NO: 58552 - DNA, 245 bp, Homo sapiens
caatttwaatcagttgtcgtgttggaagtgctttggtctagcagtgtcagtgggtctcaggctgcaatgtcaggcataccctgttcctacatcatggtccgctacaggtgaatacatgggactttcttccttgtcctaatctcccttcaaccaggtgctgttttagggtccttggcgggtaaataaaccgcggggtgctcatacacggggttgacctcgggattaggtctctaggctgtcttgta

SEQ ID NO: 58553 - DNA, 412 bp, Homo sapiens
cggccattatggccgggtattatcaaatttttaaaatacaagtttggtacgtgatttggaaaagatgccttctggatcttaagccagttgtcagtggaggtcctcagggctgcaaatgtcaagacataaccctgttcctcaccatcatgataccagatacaggtgaatacataggaactatctgcctgtgtcctcaatctcccttcaaacaagatgctgatttgtagggtacttggcaggttaaattaaaccagaagaggtgacttaataaaaaagggaatgacatttagggtataaagatctcataagaaatgtaatatgtaaattatatcttgctttatgttgtaaaatatacattgtttgcgctagaatagaaatgatttcttttcaataaaaagaaagaaggactcct

SEQ ID NO: 58554 - DNA, 308 bp, Homo sapiens
gaatagacatcaaactcaatgctttatttgtaaattagtgtttttttatttctactgtcaaatgatgtgcaaaaccttttactggttgcatggaatcagccaagttttataatccttaaatcttaatgttcctcaaagcttggattaaataccaatggatgttacctctcttgcaccaaattatccttgatacattcaaattagtctggtaaaaaaaaaggggggagaatttggggccaggattttaccacataccatgaggctgcaggcactaaggaggattttgggataggttggcatctccctag

SEQ ID NO: 58555 - DNA, 257 bp, Homo sapiens
gtacaacaadaaaacaccattcacaaatgtagcacttttaaaaccacaacttggtggggtttgtcgattccagattgccaattatattattatctgtccatcttcaacaggaatatgdgacactaaaatgcaggaaggattatcctacacggaaatggggtcatggaactggccctggggttcccaattaggttaggacagtttgaatcagctttttgaggtttaaggaccatagaacctgaacttactcacggagg

SEQ ID NO: 58556 - DNA, 304 bp, Homo sapiens
ataaatggcaaaggaaagaaataatatatattaaaaagtcattgagcaatattttttaatgtgtacctgtcttatgggaaggaaatatgcagggtatataaggaccacgggttttctaaaggtggcactattaggaattttatgtttttggtaaactaggtgaaactacactttccctcggggaaccctaggggaattaaggtttttcactaaggcaacacgctgggtaaacctcattgtcactgagtaccccaagggtcacggtatataaatcgaaggggtatagggaccaccccaacggggg

SEQ ID NO: 58557 - DNA, 192 bp, Homo sapiens
tcagtgtcttataattcatttaatctttaattcttttataattttaagttagaacatgaaatggccattttctacttcccacccagaaaagactttaatagacattcattttaggcacctcaaggcaattgatttctaatgcttatattctttgtaagataaagacaaaaattatttttaaaatcaggttag

SEQ ID NO: 58558 - DNA, 220 bp, Homo sapiens
atggccgggtgttgtcagtgtcttataattcatttaatctttaattcttttataattttaagttagaacatgaaatggccattttctacttcccacccagaaaagactttaatagacattcattttaggcacctgaaggcaattgatttctaatgcttatattctttgtaagataaagacaaaaattatttttaaaatcaggttagaaaaaaaaaaaaaa

SEQ ID NO: 58559 - DNA, 297 bp, Homo sapiens
atttactacctctgcatcttattgaaagatccagtggaaccacatgggatatcccaagtagtacccgtcttccagagtgccaagccccggctggactgccttgattgaggtatacaggagctgccaggagatcctggcacaccagaaagccacatcaacaagcccatgtagccccagcgttcagaaggccagcattgtcttccatgggagatgactcttaagccataggggctggttttccgtactccaaaccatcaggtggacacagtcctagggaccattatggatgtagtgcat

SEQ ID NO: 58560 - DNA, 298 bp, Homo sapiens
aatctgtacagcatgttactgtattgaatacagtaggcaattgtaacacaatggtaagtatctaaacatagaaaagggccagtaaaaatatggttttttaatcttcttgggcccccccattgtatatgcggtacatcattgaccaaaccatcgttatccaagaaatgactgtatttggttatgaaagccaactgttattagatcctgcttttagtcctgaaggggaccaggctttaaacacactcatacaaagattccaacccccctcccagttaaaagatggaacaaaaaagttttg

SEQ ID NO: 58561 - DNA, 263 bp, Homo sapiens
gatttgtgataattatatccaggtgctcaccaaagaaacatgtattaacaacttaaattagattttcttaacttgattaggttttcactcattttataatcagtaggagagactttctagatgtttggggcagctcttattgaatttaatgcttgtaacaatgttataacttgaattttatgaccggtatgtttttgataatgaaaaattaccttgcgacactataacgttacgtggggggttgggcggggctgggtaccttt

SEQ ID NO: 58562 - DNA, 334 bp, Homo sapiens
gtgtatgcatgtcgctcctaatgcgaattttggttatttttgatctattaacgccgccccccgttttattaccgtacacacggcccggttcggtcgtcggdcgttaaccttgcaattttacgtttccctcgggctttcggtgaggtattagccattctaccctacttttgcggggcttgggtttttgggttcgagcattcagtgccatatcctagccccttattgcagcagcccgggtcttataacccgctaccgccaggattattagaaacccccagatttaagcaactgcccgtttactaccaaaattttttgccgggagaataggacaacc

SEQ ID NO: 58563 - DNA, 444 bp, Homo sapiens
atggccggggggatcttcttgcatttctacagaagatgcactggttgccctgggtttgtatctttcacaacaaagagtcttttccaagcacagaccagaggtcaggagaggactgtcaatccagtttgcactgaaataggcattagctgcctctaaattataaattatctcagccatcccttgtccttaggattagtaattaatgaaatgctgagagaactgatgaaaagatacaactgtttcttaaaaagattcagacaaatttattatgggtttacttttcctaattaataaagacttttacatcatagaaagcattaccttccttaggtttcacaattggtttttccttaggtggaataaatgctttgtttctttcctcttgtctcttactgatggcttctgcttgtttagcctacattaataaataaaaaatacatcagg

SEQ ID NO: 58564 - DNA, 235 bp, Homo sapiens
ccgataccaaagtaggtgaggtggataggaaaaggcgaagtgtaattgacttgttgaaatgtgatggaaaacctctagtatgggtttccaggcaacgcgtctcttcgctgtggtggtgggttactctttttggaacctcttacgcttttgttttttctgaagagaacgtcgggttgtttcccttcctcggaacctaacgcttgtttttgatacggtcaggtggtgtattagcccc

SEQ ID NO: 58565 - DNA, 556 bp, Homo sapiens
atggccgggggagacaagaaattacccaaaagtaaggtgaggaggataggcaaaaagagcagaaagatgtgaatggacattgttgagaaatgtgataggaaaacaatcatagataaaggatttccaagcaacagagcatatccagatgaggtaggatgggataaactcttattgaaccaatcttcaccaattttgtttttcttttgcagagcaagctaggaattgtttcccttctactgggcacaatacacgcattgatttttgcctggaataagtggatagatataaaacaatttgtatggtatacacctccaacttttatgatagctgttttccttccaattgttgtcctgatatttaaaagcatactattcctgccatgcttgaggaagaagatactgaagattagacatgggtgggaagacgtcaccaaaattaacaaaactgagatatgttcccagttgtagaattactgtttacacacatttttggtcaatattgatatattttatcaccaacatttcaagtttgtatttggtaataaaaatgattattc

SEQ ID NO: 58566 - DNA, 196 bp, Homo sapiens
aatttctttaatggtttttataccaattattataaatcatatttttcatttatatatatatatctcttctataataatttacacttactttttcactcaatttttaattaatactgaaaaataccactaaaacctctttaaaaaaatatacactctataaaaaattatcaccaaacaaaacacacacacaaataga

SEQ ID NO: 58567 - DNA, 191 bp, Homo sapiens
ggcttttaaagggtttggggaagaaccaaatgatttataaatcagattggggcagttgtatggatatggatgtcttcttgatgagtggacacttagtttgaactcagttttgaaggaagagtaaaaatcaactaaaacctgggaaagaaggatggctctagaaaaagggatcagcaaggcaaaaaacagca

SEQ ID NO: 58568 - DNA, 299 bp, Homo sapiens
cacatacgagatatattaaacgatggaccctctacgactgacgattttagacgaagataccaaatatttttttaattacatcctatttttgacatacacacccaccggggtgggttgataccttatataccatcatccttttaaaaaacaacccctttacctttttgtgggtaagggacccttataaacctttcggataaccccgtgatcaccacccgtgggatcccttggaggggtttttgttgttttatcttttctttttttaaacaataacccatccctttttggtatcttttaac

SEQ ID NO: 58569 - DNA, 250 bp, Homo sapiens
accgggaatcggcattatggccggggtttgaaatgaggtctgtttaaagtggcaatctcagatgcagtttggagagtcagatctttctccttgaatatctttcgataaacaacaaggtggtgtgatcttaatatatttgaaaaaaacttcattctcgtgagtcatttaaatgtgtacaatgtacacactggtacttagagtttctgtttgattcttttttaataaactactctttggtttaaaaaaaaaa

SEQ ID NO: 58570 - DNA, 127 bp, Homo sapiens
tggggtaaacatatatgcaaataagtattttgaatcagagttgcgatattatatagcacaatactgcattcaaagagcatttgaaaggagactttaagcagtaaatgaaagtgtagtagattaaact

SEQ ID NO: 58571 - DNA, 304 bp, Homo sapiens
atggccggggatggggtaaacatatatgcaaataagtattttgaatcagagttgcgatattatatagcacaatactgcattcaaagagcatttgaaaggagactttaagcagtaaatgaaagtgtagtagattaaaataatatattttaaaatataggagccctgtgattttgcttcattgaagaaatacgcttttcttggcaatgtgaatgaaaaaatgttgagaacaaagaaaaatgttttctacatttacttctaagtgaaatttcattaaactgttttaaaataaaaaaaaaaaaaaaaa

SEQ ID NO: 58572 - DNA, 211 bp, Homo sapiens
gaaaaggtttttaggaagtatggcaaaaatgttgtattggctatgatggtgacatgatatagtcagctgccttttaagaggtcttatctgttcagtgttaagtgatttaaaaaaataataacctgttttctgactagtttaaagatggatttgaaaatggttttgaatgcaattaggttatgctatttgacaataaactcaccttgaccta

SEQ ID NO: 58573 - DNA, 260 bp, Homo sapiens
actgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggagagacaactgttttaataaaagagtttacattca

SEQ ID NO: 58574 - DNA, 244 bp, Homo sapiens
gtataatttttttcatatgatagactgagctttatgcacacaggtggactgggtggttatggatcaggagacagtgaagatgagaggagttacagaggatctgagtcatctgacacttgtgatgaagaattacggcatcgaatccggcaaaaacaggaagcttttttgagaaaaggaaaagaacagcagctattacatgataaacagatggaagaagagaagcagcaaacagaaagggttataw

SEQ ID NO: 58575 - DNA, 278 bp, Homo sapiens
atgagtcatgaggtgggatttcaacaagtctgcagtcaacattgcatcacaaatgacagacagtgcagagatttgagtgtacttttcacggtgagtgtggaaagaggagaagaataagtgttggaatacttctcttactattttcaagctggataacttggacagacaagaacttatttcacagaaattgcagcacttcaagcatttttggtgacaagataagagttgggcatacttctttgaggcagggtattaaagaagacataataactagacaw

SEQ ID NO: 58576 - DNA, 510 bp, Homo sapiens
atggccgggggacagcaaatgagtcatgaggtgggatttcaacaagtctgcagtcaacattgcatcacaaatgacagacagtgcagagatttgagtgtacttttcacgctgagtgtggaaagaggagaagaataagtgtgggaatactcctctactattttgaagctggataactgggacagaaaagaacttatttaacagaaatggcagcacttaaagacttttggtgaaaagataagtttggtcatacttctttgaggcaggatattaaagaagaaataataactagacattgggaatgaaaaacaaaaattcagaaatagtgttctggacttgattgtaaattcaggagtatttgcttggggtcatagttaaagcctagttctcccaggtaaatacagggatcaataaaggctggaaactaaggacacaaccttggggcactgtctcaatttgtgggtagaaagcagtgtaaccaatgaagataaagggtaattgatctcagcaggt

SEQ ID NO: 58577 - DNA, 189 bp, Homo sapiens
tgaacagaatttgaactgtaagcaaggcaattctcaggaaggtctggaagatagcatgcatgggaagtaacaagttgctaggcttcaatggctatcggtagcaagccatggaaaaagatgtgtcagctaggtaaagatgacaaactgccctgtcttgcagtcagatttccagacagactttagagctat

SEQ ID NO: 58578 - DNA, 178 bp, Homo sapiens
gttgcgggattcaagatgaaccccttttatatatgctaaaacccctggggaatatgccttgggatggtattatggagctcaaaactctaacctcttaatagccttataggactcaaaacctctcggatacaattaaccaattggggatatgatcttaagctcctgtgtcagagctact

SEQ ID NO: 58579 - DNA, 632 bp, Homo sapiens
atggccgggattccaagatgaaccttttttatatatgctaaaaattttggggaatatgttttgggatgtattatggagctaaaactctaacctcttaatagttttatagaacttaaaaattttttatacaattacccaattggtgatatgatcttaagcttttgtgtcagattatttaatatggtgacttcatgctttattatgccttattatggctgacgtattactgcggtgaaacaaaatatctttaaaagttaaaacatccagatatataagctattttttcctaaggataaagtacctttgagcatgagtgtatcacagctttcattaggaaaacttttcattacatacttgtttaaactctgtcttccagggtaaaaataataagggtgaatcattttattaaaaatactttttaagaaaataactatgaacatctgaatattaaagatataaaaatgcgcataattcatatttcaggtggtatttgcattcagtgccttactgggatctcagaacatttaatgattctaacattctaacagcatagatatatacattcattttgtctgatatctaataactgacattactctgcaataacaaattcaaaaaaaaaaaaaaaaaaa

SEQ ID NO: 58580 - DNA, 206 bp, Homo sapiens
aagaagagagtttctaatcagatgcaacggcccaaattcttgatctgcagcttctctgaagtttggaaaagaaaccttcctttctggagtttgcagagttcagcaatattatagggaacaaggtcttatgggcccaagagttacaaggatacacaaactacttattatctctagagaggttttgctttgtttatcttagcctctat

SEQ ID NO: 58581 - DNA, 250 bp, Homo sapiens
gggtctattaaggtgatatatttaacaatatttttgggtgttctggcagtttaaaaaaattggttggagaatttaggtttttattagtaccatagtaccatttatacaaattagaaaatgttatttaacaactgaattatctatacaaatctttattaatcactattgttccagcaggttttcaaggcaaattaataatcttatttgggggaacttcaattgtaaaatgaatcaggattaacacaggtac

SEQ ID NO: 58582 - DNA, 211 bp, Homo sapiens
tggcgggagtaaaacaaattgcgttgtttaaaggattatagtgctgcattgtctgaagttagcacctcttggactgaatcgtttgtctagactacatgtattacaaagtctctttggcaagattgcagcaagatcatgtggcatatcatccccattgttaaagcgacttcaaaaatatagggagcacagttagttattttcacacagttct

SEQ ID NO: 58583 - DNA, 236 bp, Homo sapiens
tggcgggaaattaaagatgtctagttgctttttataagaccaagaaggagaaaatccgacaacctggaaagatttttgttttcactgcttgtatgatgtttcccattcatacacctataaatctctaacaagaggccctttgaactgccttgtgttctgtgagaaacaaatatttacttagagtggaaggctgattgagagtgttccaatccaaatgagtgcatcacaaccttaca

SEQ ID NO: 58584 - DNA, 152 bp, Homo sapiens
tcatgaattttatttctgtttgtcgataagaaatgtaagagtggaatgttaataaatttcagtttaggtctgtaatgtcaagaatttaagaattaaaaaacggattggcggaaaaaaaaaaaaaaaaaaaaaaaaaaaaaatttggggcccc

SEQ ID NO: 58585 - DNA, 111 bp, Homo sapiens
tggcggggtaggaacaagcatgatcttgttactgtgatattttaaatattccacagtactcactttttccaaatgatcctagtaattgcctagagatatctttctcttacc

SEQ ID NO: 58586 - DNA, 147 bp, Homo sapiens
gggggggttttcatctatgagggtgtttcctctaaacctacgagggaggaacaactgatcttacaggaaataccacactcgagatgggtgctggtcctgttgatcccagtctctgccagaccaaggcgagtttccccactaataaag

SEQ ID NO: 58587 - DNA, 202 bp, Homo sapiens
tggcgggggctaatggtaaggtaacattgctttgttgtacttttgaacaagagctcctcctgatcactattacatatttttctaggaaatctaaagttcagaagagaatgtatcactgctgacttttattccaatatttggatggagtaagttttaggggagaatttttttcagtttggagtttaatcttttgaaaagaaaa

SEQ ID NO: 58588 - DNA, 187 bp, Homo sapiens
tggcgggataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagaccccttaaaaaagttaaatga

SEQ ID NO: 58589 - DNA, 320 bp, Homo sapiens
catgatgccaagctcagaaaaacataaagcaccttgaaaaagacttggcagcttcctgataaagcgtgctgtgctgtgcagtaggaacacatcctatttattgtgatgttgtggttttattatcttaaactctgttccatacacttgtataaatacatggctattttgatgtacagcgtatgtctcttaaccagttcacttattgtactctggcaatttaaaagacaatcagtaaaatattttgcttgtaaaatgcttaatatcgtgcctaggttatgtggtgactatttgaatcaaaaatgtattgagtcatcagtaag

SEQ ID NO: 58590 - DNA, 130 bp, Homo sapiens
aggtgaggcaggagaatcgcttgaacccgggagacggaagttgtggtgagctgagattgcaccattgcacttcagccttggcaacaagagtgaactctattaaataaataaataaataaataacctacct

SEQ ID NO: 58591 - DNA, 304 bp, Homo sapiens
aatctaaataaaaagaagaatttgaaaactttctctttgcatttcttcttcttcttttttaacttaaagctgaattcttccatttcttctgcacatctacttgcttaaattgtgggcaaaagagaaaaagaaggatttatcagagcattgtgcaatacagtttcattaacttctttccccgctctcccaaaaatttgagatttttttttttcaacacactttacacctctctatggggaaatgtcaaccctgtgaggagagaccacaatataaattgagaagatataaaccatatacatctgtg

SEQ ID NO: 58592 - DNA, 205 bp, Homo sapiens
tgcttttctactcaaatactgttttttcagtagaactgaatgtttcaagcattgttgttggcttgagttgaattgtggaattaggctcaaacaaggatgtagaaaattaacaagaagtatgatgatagggctggaacatcatgtgggctcgctggtgtgtcttgtctctaaaactcttgtgtaaaaaggaaaatatttatattaa

SEQ ID NO: 58593 - DNA, 481 bp, Homo sapiens
atggccgggctactcaaatactgttttttagtagaactgaatgttcaagcattgttttgctgagttatttgtgattagctaaccaggatgaaaaataacagattatatatagtttgaactatttttcgtgtgcttttttaaacttgttaaaaagaaatttatataaaatttaaaatacaaatgttaaattatccagaaatacagaatagttaatattgctagaaccaaataacctctaaaatgtttttattttggaattttgtcatgttaagcacttttgtatctgcacaatcagtaggtaagaatcaatcctcctttctaatagtacagcagacttagcttcaagttcataggctagtactatatcagacattgggtcaaataagctttcataacttttatttaaggcagaactttcagaagagtatttggcgaatgttgcaaaaaaagtactgaaagtaatttaaaagcagcaaacata

SEQ ID NO: 58594 - DNA, 198 bp, Homo sapiens
acatgatggccggggagatgttgtctcttaaaaaagtacgaaaagtgttagctggacatggttgcttgtacctgtaggtctagctgtgggaggctgaagaaggagcaatccttagcccttggaatttgaggctgcagttagttattggtgtgtcacttcactctcaaccaggtgaccaagttagagcccctctcttta

SEQ ID NO: 58595 - DNA, 311 bp, Homo sapiens
aaagaaatgtgaaattaaaaagaattcttccaaaaagcagcttccattaaaatgggaattcagtatgcacatactgaatgcatatatgtaggaccatacagaatttaggtggataagggctagaaattttgagcaacaaaatttgtcacttgaccagattttatcttcaaaaactgtattctactccttctcctttgctgttgaggtaacttgcatattatatgtattctgtatactcagttcataaggttatttagcacaaagtatagcagcttcacctcggagagctgcttttgctcagtaaattcaac

SEQ ID NO: 58596 - DNA, 292 bp, Homo sapiens
atggtgcatacaaggccatccccgttgcccaagacctgaacgcgccttctggtttggacagccgttggatggacagttatgaaacgagtcaactggatgaccagagtgctgaaacccacagccacaagcagtccagattatataagcggaaagccaatgatgagagcaatgagcattccgatgtgatttatagtcaggaactttccaaagtcagccgtgaattgcacagccatgaatttcacagccattaagatatgctggttgtagaccccacagtaaggaggaggataag

SEQ ID NO: 58597 - DNA, 322 bp, Homo sapiens
atgatggcaggggcaggtatctttgtaactataaatagtgcatgctcagccatgtacactgtaaatagcctttaccaaacgtgtttgacaggaccataattaacatcacttagtgaattgtgataaagaaaaaaaagccatgatttattcgatgtgattagcttgtttttatgtggcgccaagaacgaacctgtttaacagctgtaaccaatggtactgatctatccatccaatgttgtcattatatttgactgtggttcaacagtattgcgttgtcagactaggaaagctaaacgaacaaaatggttttagttagctgatg

SEQ ID NO: 58598 - DNA, 324 bp, Homo sapiens
acatgaggccggggatatacaaaggactaagatattttcgtcttgaagagacttttcgattagtcctcatatatttgtctactaaaagagagtgtttaccatgaacagtgtgttgcttcagcactattacaaagacaactggggcaggtactctaatataaaggacaggtggtgtttctaaataattggctgctatgggtctgtaaaaaccaagttaattctatttgcgcaaggggtttggcaaagcacatcaatgttagactaggtgaagtggaatggtataattcactcgataatggatctcatgggggggcccgcgaggga

SEQ ID NO: 58599 - DNA, 234 bp, Homo sapiens
agttgagtgcagagggcttttataacaaacgtgcagaaattttggggggctgtgatttttccagtattaaacatgcatgcattaatcttgcagtttattttctcattgtgtatgtataaatcgcttttctctgcagcacgatttctcttttgataatgccctttggggacaactagttatcagtaactaaatgtatcttaaccataatggcggcttctgttttgtcattaacac

SEQ ID NO: 58600 - DNA, 177 bp, Homo sapiens
aaacaaaaatttatgcttgatcatggaaagattaatttcatgagacattattcttcacgggagaccggttgttataacttaaactcccacggaaccccaggtttttgcggaattaaaacgggttttatttaagttaaaaatacccccttcccatacaacaaaatataccggggtttt

SEQ ID NO: 58601 - DNA, 361 bp, Homo sapiens
atggccggggactgattataatgagaaactgtaatctacttacgtaaaaagtgtttttaaacaaaaatttatgcttgatcatgaaagataattcagagaaatatctcacggaacggtgttatacttaaattgcaggtcctcagttttgcggattaaaagtttgtatgaattgaaatgaccaatccatacatcataaatacagggttttttattttccagttaaggaatgacagtggttatgacttaagttgtggtattgtaaaagaacagttttctcgtgggaaccagtgtctctaaatccgttagagctaccctgtttccctgaaggtttgccatcagattccaaatgaaaaccataaaa

SEQ ID NO: 58602 - DNA, 150 bp, Homo sapiens
tcattattgtgacattttggaatactttgaagttttatctcttgcatatactttatacggaaggattacgccttaaaaatacgaaaataaattttacaaggtttctgttttgtgtggaagagtaattgatgttgctaagaatgatgtttg

SEQ ID NO: 58603 - DNA, 241 bp, Homo sapiens
catcctaagcctcaaatcatgtaattaataatttgcctttttatttatgacctaattgtgattcttttattaataaaagctaattgggaaagggtccctgattaaggtgatgactagacccacaattaatttttctgcagtatattaagtattttaccacagtatttaaagatatgtaatatttccctgataaaactatcctttaagaggggtacgttttagggggtcatcattttgatgt

SEQ ID NO: 58604 - DNA, 237 bp, Homo sapiens
tccattatttgagtttgacatttaataactctgctggaaaatctgtaaaaaagaaaaacaggtttgctagtgactaggccccgcatatgtgagtgaaagtacttcaggcacgctgcctcctggtaccagctatgcagggagggaggacccacactgctacacttctgatcccctttggttttaactccccaaatctaaaaagaaactctggataagagaaacctgctctttccctaa

SEQ ID NO: 58605 - DNA, 149 bp, Homo sapiens
aatgtggtattcattcacttaaaggtacctctgtagaaataacctaaaactgcagaaggatcttaaagatctaaacatggtgtccttaggaactgcaggttttaggtctaatgtataccgcattattaaatggtatagggggttgttga

SEQ ID NO: 58606 - DNA, 149 bp, Homo sapiens
atgttttgtggaccactttgggtttcttttttgcgtgtggcagttttaaggtattagtttttaaaatcagtactttttaatgtgaaacaacttgaccaaaaatttgtcacagaattttgagagccccttaaaaaagttaaatgagagaa

SEQ ID NO: 58607 - DNA, 237 bp, Homo sapiens
tagggtgaaaaggaactttctgttctgagagctaagcgactttacgtgctactaaaaatgtctgacactgaaataattttactcaactatgttttcaacaagcaaaaatatagtattctgaggttagggtgtcattacaaaatatttagtgtgaccatttaatttgggcttgtctcatggggtctttaatttcagtggccattacagcttatatatgtggtttgggggggcatccac

SEQ ID NO: 58608 - DNA, 202 bp, Homo sapiens
caaatactaatgttaattgcccaattgagtgcttcatgcctttagatgtacaggctgacagagaagatttccgagagtaaatcatctttccaatccagaggaacaagcatgtctctcttccaagatccatctaaacttgagtgatgttagcagacccagcttagagttcttctttctttcttaagccctttgctcttgaggg

SEQ ID NO: 58609 - DNA, 230 bp, Homo sapiens
gcagagtttctttcaaacttcactgaggcatcagttgctctttggcaatgtcccttaaccatgattattaactaaggttgttgcttgagtttacaaattctacttgttgcattgatgttcccatgtagtgaggcaattttaggtttggtgtaaaaaaacccccgggctgaagttggcatttcagttaaaagaaaaaaggagactatgtcccccatttgagacttttaata

SEQ ID NO: 58610 - DNA, 110 bp, Homo sapiens
agtgaacaggcaacctacaaatgggagaaaattttcgcagcctgctcattcttgacaaagggctatatattcaagaatctatcaataggactcaaacaaatctatcaaaa

SEQ ID NO: 58611 - DNA, 130 bp, Homo sapiens
atggccgggatcagagtgaacaggcaacctacaaaatgggagaaaattttcgcagcctgctcatctgacaaagggctaatatccagaatctacaatgaactcaaacaaatctacaaaaaaaaaaaaaaaa

SEQ ID NO: 58612 - DNA, 168 bp, Homo sapiens
tttgtgttagtgttctttataataaaacacaaagcagcctcctggctggctgtgttgcaagtgactctttcttagacagctagaaagatgctgactttgtcaaacttgcatttatatgagaaccttctgtctctaatatcacaggaataaactttctttaggtgctgt

SEQ ID NO: 58613 - DNA, 130 bp, Homo sapiens
tgtgatattttaaatatccacagtactcactttttccagatgatcctagtaattgcctagagatatctctctcttacctgttatttatcagtgttgtcccagtattttgtgtacgggggagattgtattg

SEQ ID NO: 58614 - DNA, 198 bp, Homo sapiens
  misc_feature 146: n = A,T,C or G
gtaatatgaaaatatttaaacagcattacaaaatcctagtttatactagactaccatttaagaatcgtgtttttatataaatgcccaaatttgagatgcattattcctattactaatgatgtaaggacgaggataaattccaaganactttcaactcttttgtcctttcctggcctcttactggatcccaaaacgcat

SEQ ID NO: 58615 - DNA, 154 bp, Homo sapiens
agcaacttgacttaccgaggaattgtgaaattactttacgcttgcagctgtggacttggtcttacagcctctgctcttctgcccaaacgggccatgcagtttggatcaagaattgccaaaatgggaaaaattaatgaaaaggcatttgttaaat

SEQ ID NO: 58616 - DNA, 128 bp, Homo sapiens
caaagaggaacagctctttggacactaggaaaaaaccttgtagagagagtaaaaaatttaacacccatagtagggctaaaagcagccaccaattaagaaagcgttcaagctcaacacccactacccaa

SEQ ID NO: 58617 - DNA, 120 bp, Homo sapiens
agaccatagtcaacaagtaccgtaagggaaagttgaaaagaactttgaagagagagagacagaatagaatagaataggataggataggataggaatagaataggaataggtaggaatagg

SEQ ID NO: 58618 - DNA, 192 bp, Homo sapiens
taaatgtaaaatttggagtgaatatatatgccaatatttagtaaagcttttcttttttaatttccaggaaaaaataaaaagagtatgagtcttctgtaattcattgagcagttagctcatttgagatagagtcaaatgccagaccactagctctgtattaatccccatcattactggtagagcctcatttga

SEQ ID NO: 58619 - DNA, 268 bp, Homo sapiens
aaatgagactgagggaagaaaaaaaatctctttttttctggaggctggcacctgattttgtatccccctgtagcagcattactgaaatacataggcttatatacaatgcttctttcctgtatattctcttgtctggctgcacccctttttcccgcccccagattgataagtaatgagagtgcactgcagtgagggtcaaaggagagtcaacatatgtgattgttccataataaacttctggtgtgatactttcaaaaaagaaaagaga

SEQ ID NO: 58620 - DNA, 202 bp, Homo sapiens
gcaatatttaagaacctaatgctgtttaattttggtacagcttccacattgcatgttcactttagtatttgcaatttgatatatttcatggtggcaaaatattagctctgttttgggacatttaaaatagaactatccttgttcgatagcataggagaatgttctggtgattgtcagggtctcctaatatttatctcagttc

SEQ ID NO: 58621 - DNA, 231 bp, Homo sapiens
gtgattctaagatttggtttgggatcaataggaaagcatatgcagccaaccaagatgcaaatgttttgacatgatatgaccaaaattttaagtaggaaagtcacccaaacacttcttctttcacttaagtgtcttgcccccaataactttaggaacaagcattatttttttactgtgatatttaaatatccacagtactcacttttttccaaatgatcctagtaaattgcc

SEQ ID NO: 58622 - DNA, 219 bp, Homo sapiens
taacagtgtcctagattgagctttcagaggtaaaatgtacaatatcagagatctgaaaatactggatgggatcagaaattgcaaaagataagatgtgcatttggaggtatagcaattacccctatttaggaataaaacaggagaatgggcccattgaccccagatttcagggaagggggtagagggaggaggggacacaccacattcacttagggaaat

SEQ ID NO: 58623 - DNA, 314 bp, Homo sapiens
atggccggggattggaagctataacagtgtcctagattgagctttcagaggtaaaatgtacaatatcagagatctgaaaatactggatgggatcagaaattgcaaaagataagatgtgcatttgaagatatagcaattaaaactattcagaaataaaaacagaaaaaagaccaatgaaaccagaatgtcagtgaagtggggtgaaggaagaaggagacagacaaaattcattaaggaaattgtgtcccagaattttcaaaatatttcattaactataaattcatatatctaagaacctcaaagaaccctaaaca

SEQ ID NO: 58624 - DNA, 232 bp, Homo sapiens
cattatggcgggctggaacagatttgataatcttattcacagttgttattgtttacagaccatttaattaatatttcctctgtttattcctcctctccctcccattgcatggctcacacctgtgaaagagaaaggattcagattgattatatctcttaagaattcagaactagtgtattcacttacctagttcattatagggsgtatctaggcattgtttggatatgcacct

SEQ ID NO: 58625 - DNA, 253 bp, Homo sapiens
ccatgatggcgggggtagaaggtagttccatgttccatttgtagatctttaagatttttatctttgataacttttaatagaatgtgggctcaggttcttggtccttcaagccttgtattggctttggattttcagtagggggacagtttgatgtggagtcaatctcttttgtacacagggagctttataaaatttcattcacgaaacctcttattttgtgggaggtgtgttgtgaaattgggaggaccccctr

SEQ ID NO: 58626 - DNA, 234 bp, Homo sapiens
ccattatggcgggggatacattcaaatttgtctggttaaaaaaataggtggtagatattgaggccaagaaatattgcaaaatacatgaagcttcatgcacttaaaggagtattttcaggataggatttgcatacttacccaagtggaactttttctagagttatttttcactctaggccatgtatgttcctctctggatatttgcatgtaagtgtttataggctctcctggcaa

SEQ ID NO: 58627 - DNA, 194 bp, Homo sapiens
ccattgtggcggatgagatggctgaaaaaataccacatcgtctgttttcactaggtgatgccaaaatattttgctttatgtatattacaggtctttttaaacactggaagacttatgttaaactcttattgtggaggcaggattctcttcttattttttcagattaaaattcctctttgaccaaaaaaaaaaad

SEQ ID NO: 58628 - DNA, 212 bp, Homo sapiens
gggtattcaggaattcattagcatgatatttacaatattgcacatggcagttgggggatattttgtaatagttattaatattatctcggatttgtattatgttatctcagacataacatttgttgaggctaattgccaccctttaccataggcattttgatggatgaggattacagggattgtgattagtttcatatttggaaatgtatttg

SEQ ID NO: 58629 - DNA, 507 bp, Homo sapiens
atggccggggtattcaggaattcattagcatgatatttacaatattgcacatggcagttggtggatattttgtaatagttattaatattatctcgaatttgtattatgttatctcagacataacatgtgtgaagcttaatgacaacctttacattagcaatttgatggatgaggaatacaaggaatgtgaatagtttcatttttgtaaatgtatttaaaaataaatgaatttcaggtttaatgagtaattttgaattaaactttttgtgtctgttattcatatttatattttaagtaacctaagatagaaataagtttttgaaaataattttgactttttgatatcttacatttaatttgtattttaatgaaaacattgaaatgcatttatttagaataaaatgggaatttttaccttttagataattgctatcagtggagtataaaatgggaaaatatcatgtcatataatgttgatgctcctgaatggggaaaaaaaaaaaaaaa

SEQ ID NO: 58630 - DNA, 206 bp, Homo sapiens
tggcggcagtattttaaatgaagtgattctaagatttggtttgggatcaatagagaagcatatgcagccaaccaagatgcaaatgttttgacatgatatgacccaaattttaagtagggaagtcaaccaaaccatttttgttttccacttaaggtgttctggcccgcaattactgtagggaccaggcattgtatctggttcttgtg

SEQ ID NO: 58631 - DNA, 115 bp, Homo sapiens
ccattatggcgggagtctgagaaatagcagatagtctcatatttaggaaaactttccaaataaaataaatgttattctctgataaagagctaataaaacccccccaaaaaaaaaa

SEQ ID NO: 58632 - DNA, 205 bp, Homo sapiens
tggcggggggaaaagagaattttagaagaatctagaaaccttttcattttctttaggacaaatataatttcccccaaaaatgagaattctttgttattctctaataaacactttgggtgtcgctaagccttgatctgtgcactagcagtttctcttttgtcactagcaatgtctctggcaactgaaccaggtcctggagggagaa

SEQ ID NO: 58633 - DNA, 310 bp, Homo sapiens
ggcaggaggatcgcttaagcacaggagttggaatccagcctgagcaacagagcaaaaccccgtctctaaaatacaaataaaatatttgtgtagtttttgattaaaattgactacagcggtcagtataaaatacatgtcgcttttaaggaagtgctctttatgtatctaacagagtggaagtttttgcattggtaagagcatttatatatgctttgtttcagggtttatggatttgtatacatatattgtcacataggtgtcatactctcaatttactctgagtgaagctcaacactctgcatacaccgtg

SEQ ID NO: 58634 - DNA, 246 bp, Homo sapiens
aaaggaaatatcaaagtgtttttcaagcctcttatattcagtgtgtgccacaagattaaataaatgacaatgtaattatgaattcatgttttagagctgtttactcattagtaaaggaccccaatgttagtaaagacaacctattaaatgtatgttaaagggtcttagtattgtacagggataaagcaaatgcatgaaaatatgtcatgtactgaaaattaaactctacttcagtgttcagccaca

SEQ ID NO: 58635 - DNA, 220 bp, Homo sapiens
aaataatcgaagtaattttgggtggggagaagaggcagattcaattttctttaaccagtctgaaggttcatttatgatacaaaagaagatgaaaatggaagttgcaatataaggggatgaggaaggcatgccttgacaaacccttcttttaagatgtggtcttcaatttgtataaaatggtgttttcatgtaaataaatacattctgtgaggagcacaac

SEQ ID NO: 58636 - DNA, 232 bp, Homo sapiens
caagtgacaatacattccaccacaaatacactcttgttcttctagcttttagactatatgaaaaaaccgggtgcttcaaagtacatgataagggaacactatacctgtcatggatgaactgaagactttgccctgttcaatttttaaatattattttcaggtcccttgcttaccaaaggaggcccaatttcactcaaatgttttgagaactgtgtttaaataaacgcaaatg

SEQ ID NO: 58637 - DNA, 328 bp, Homo sapiens
aaaaaataaataaaagctagatactggaaacctaactgcaatgtggatgttttacccacatgacttattatgcataaaggcaaattttcagtttaagtaattgcctacaataaaaaggaattttgcctgccattttcaggatcatcttttgaagctttctgttgatgttaactgagctactagagatatatctcatttcactaaatgtaaaatttggagtaaatatatatgtcactatgtagtgaagctcttctcttttgatttccaggagaaaataaaaagagtatgagtcttctgtaacacactgagcagctagctcatctgagat

SEQ ID NO: 58638 - DNA, 315 bp, Homo sapiens
catgtaatgaatgaggttgatactaacaaagacagattggtgactctggaggagtttttgaaagcacaaaaaaaaaagaattcttggagccagatagctgggagacattagatcagcaacagttcttcacagagggaggacttaaaggatatgaaaatattattgctttacaagggaaatgtgactctaaggagaagggcagatgagcttcagagcacacaaagggagcatacaacagtcagcatgatcaacatcagagtctcacacagcatcggagtatcatcacggtcatacaagcagattggcacacacaag

SEQ ID NO: 58639 - DNA, 105 bp, Homo sapiens
ttttaagttattagtttttaaaatcagtactttttaatggaaacaacttgacccaaaatttgttcacaggatttttgaggcccatttaaaaaaggtaaattagga

SEQ ID NO: 58640 - DNA, 275 bp, Homo sapiens
  misc_feature 240: n = A,T,C or G
gactttcaaatgtgggtacctcagctatatcactggcccacaatcaggaaaccttaccgctttttatttatctatggccttggtaaaaaacacaagtctttgacacatgaaaatttgcctgagagagacacaaacaagacgcatttccctgtctgcgtttctggagcagacctttatccaaaagtctgtgtcacatctgtcccttgagcactgcattgacccaaaaggagagagtccatnctgaatgagagaaatgaaataatgagattttgcac

SEQ ID NO: 58641 - DNA, 538 bp, Homo sapiens
atggccgggaagacaaaggtgtccttcataatgaagttaaagtgagtatactgtggagaggacttccaaatgtggttacctcagctatatcactgcccaacatcagaaaacctgacggctatgattactatgccttttctaaagatcaatactataacattgatgtgcctagtagaacagcaagagcaattactactcgttctgggcagaccttatccaaagtctggtacaactgtccttagactgatgagcaaaggaggagtcaactaatgaagaaatgaataataaattttgacactgaaaaacattttattaataaagaatattgacatgagtataccagtttatatataaaaatgtttttaaacttgacaatcattacactaaaacagatttgataatcttattcacagttgttattgtttacagaccatttaattaatatttcctctgtttaatcctcctctccctcccaatgcatggctcacacctgtaaaagaaaaaagaatcaaattgaatatatcttttaagaattcaa

SEQ ID NO: 58642 - DNA, 295 bp, Homo sapiens
tgggatgtgtgtgtgttctcaggcaatatattttgctaaggatgtgaattcacaggtcacggttacatatatatggtctcacagatataaaaaccctctcacagatttttgtgatatagctggaaagggatctctctgatgagagaaaaaatcactctcaaacacatcacagggtttgataggcttttttagatgggtctacctccatcacagttgagattttccacagctttctagatgtttgaattgtcccctaaaatatccccctgggttttcccccacatctccccgtgta

SEQ ID NO: 58643 - DNA, 408 bp, Homo sapiens
cggccattatggccggggatgaagatgaagaataagtggctatcctttaatgatgcgtgtggaatgtgtgtgtgtgctcaggcaattattttgctaagaatgtgaattcaagtgcagctcaatactagcttcagtataaaaactgtacagatttttgtatagctgataagattctctgtagagaaaatacttttaaaaaatgcaggttgtagctttttgatgggctactcatacagttagattttacagcttctgatgttgaatgttcctaaatatttaatggtttttttaatttcttgtgtatggtagcacagcaaacttgtaggaattagtatcaatagtaaattttgggttttttaggatgttgcatttcgtttttttaaaaaaaattttgtaataaaattatgt

SEQ ID NO: 58644 - DNA, 270 bp, Homo sapiens
tcctctctgttcatgggggttctttgaggcttgaaggttgattttactatcttggacctttttgccaatacaccaatcttcaaacacacccgcggtatctctttacacataggatttaactctctttctccttgagtgggaaacacacttgggacatatattacacacacatatatatataactctatatatatgtgcgcagacactgagtttgcacacacaaggggaattttggaggtagcacagctattatattctctgcgcgctctc

SEQ ID NO: 58645 - DNA, 635 bp, Homo sapiens
atggacgggcaagaatgaattagagtgaaggaaagctgtgtgacacctggcattcctctctgttcatggagcttctttgaggcttgaagtttgattttactatctagacctctctggctaatacctattcttcaaccacctcggttactctgacataggaatttacttcttttccttgagtggaaaacactttagaaaataataacaaacattattataaactaatatatgtgagagtacttagttgaaacaaaaaggaattttagtagacagtattatattatctttgaaaatcaaggagaagtttatgcaacttaaaatgtttacacactgtgctgcaatctactgtttgtgaatgtcaatgtattatcaggaaacatgtctatacgatcgcagagttgtatttcctcacaaacttctttacgaagagtgaaatatgtttttgtacctctcagtttcagtcagggacatattttgtgcaatatttccggtgattgtgcctatgtgtgatgaatgaatgcatttcaatcaatacaatggcctaaatcaataaccttgatggatgccttggggaaaggaatcaacaggtttaaaaccttcaaggaaagttccaaaaggtccggtggttccaaaaa

SEQ ID NO: 58646 - DNA, 235 bp, Homo sapiens
tagaggacatcaggcctacgggaccctctgtgaggcctcacttgtacacagtccgcctttggtaaacaggcccatgccttggtaaacagggacacaggcaaataaaacacagtgcacacactgcacattcctttgagtaatatttgggtgtagagatctcccatttcgcatcttgcggttttctttgggagcacatctaagggcgcaccacaccctctggaggtttttactttaa

SEQ ID NO: 58647 - DNA, 586 bp, Homo sapiens
atggccggggatggtcaagaagtctgaaagagtcttgagggaaaaccagtgtgcctacatcaatgattccattggcttacatcgagtagagaacatcagccatacggaacctgctgtgagccttcacttgtacagtccgccttttgatacatgccatgcctttgatcaaagaacaggacataaaaacaaagtcacaatgacattccatagtaaatttgggatcagaactccaaatgcaacttcgggctcgctggagaacaactaaggggcaccaaaccctctgaggttttactttaaggttcgctgtatgtttgccttgggcaaaaaggctacctaccacgtgctatccagtaatatacttaaataagccaatacttagatctactgtaaggcagatgctaattataaggcattaagtaagcaaatagtgccctcagctactgcagaagaaaagtcccactgaggaaaagaaagtcttgtgatttttaaaggcaagttttcaaggtgctctcatagttctaacctccaaattccaattaaatccaaaactaggagcgtcaggttgagggtttcataagccttttgg

SEQ ID NO: 58648 - DNA, 193 bp, Homo sapiens
  misc_feature 163: n = A,T,C or G
agtgtttgccgaatctttggacaagatgtttgttttgtatatttaaaaatcacaagtctacctttttcaaatgatctagtaattgcttaaaatattttcctctaccctgtaattaaaaattttcaagaatttttaccggaaagttgagttaaacacacttggngatcgaggtgaaaagggggttttgggatat

SEQ ID NO: 58649 - DNA, 386 bp, Homo sapiens
atggccggggatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactggggaaagacaactgttttaataaaagatttacattcca

SEQ ID NO: 58650 - DNA, 147 bp, Homo sapiens
atgcatcgtaaacctcagaggaagggatgtttttggaccactttggttttttttgcgtgtggcagttttaagttattagttttaaaatcagtactttttaatgggaacaacttgacccaaaatttgtcacaggattttggggcccct

SEQ ID NO: 58651 - DNA, 141 bp, Homo sapiens
aattagaagataaaacatactttcagaagacaaagataaatttccaccttgacaagtaggaagcagaagacaaaagacaagctaggacacaaaaagctaagggcaaaatgtacaaacttaggaggacattgggcaggtagg

SEQ ID NO: 58652 - DNA, 195 bp, Homo sapiens
aaatagtataacttaatttcttttcctgaaattaactgtaaaacattcaggggtcctaccatttctgttcaggaaatcgtgtagtttattgttgttatttaacagtattaagtggatttgtgtatattccattttaacctttatttgtgaatagtgattgtggcatgtttggggtgttattttcaatattccacg

SEQ ID NO: 58653 - DNA, 226 bp, Homo sapiens
cacgttgatgtcaagactaccgatggttacttgcttcgtctgttctgtgttgggtttactaaaaaacgcaacaatcagatacggaagaccttttatgctcagcaccaacaggtccgccaaatccggaaggaggatggattggaaatcatgaccccagaggtgcagacaaatgacttgaaagaagtggtcaataaattgattccagacagcattggaaagacataga

SEQ ID NO: 58654 - DNA, 265 bp, Homo sapiens
gtggagttggtgaatcggttgttctttcctcacatttggatgattgtcataagggtttttaggcatgttcctccttttcttcaccctcccctttttccttctattaatcaagagaaacttcaaagttaatgggatggtcggatctcacaggctgagaacttgttcacctccaagcatttcatgaaagagctgcttcttattaatcatacaaactctcaccatggtgtgagagtttcacagatctttcacagtaaaagtatacctt

SEQ ID NO: 58655 - DNA, 132 bp, Homo sapiens
  misc_feature 96: n = A,T,C or G
ggtgtttaaaaaagtttctagtatcacatagaagctgtccttgagctgtcctattggagggtaatttgatactgaccttgtagctatattttcctnattggttttcattgtcttgaggctagtgatttgcct

SEQ ID NO: 58656 - DNA, 121 bp, Homo sapiens
  misc_feature 20: n = A,T,C or G
aatgatgatgatgatgatgntgatgatgaaagatgccaggggttcaacttggatagttgttcccctagtctgtctgatcaacatattttcatatgaatcctttccttatcaggaggtctaa

SEQ ID NO: 58657 - DNA, 155 bp, Homo sapiens
taagtattgttacacagggttatgcaattcccggcctggagcatttttgaaattcaaattgtctgtcctgtggagcaggcagtgattttgttccaaaactttgtatacacatttgggggagaggactttatattttcaggggtttgtcttgattt

SEQ ID NO: 58658 - DNA, 173 bp, Homo sapiens
  misc_feature 48: n = A,T,C or G
actgttaataattacatctcttaacagtctctgagagtactttacctnaagacagtatgagaaaatattcaagtaacactttaaacccagttacccaaaatctgattaggaggtataaggtgctctgaagtgtcctaaatattaatatcctgtaataaaggctctttaaaatg

SEQ ID NO: 58659 - DNA, 182 bp, Homo sapiens
tcaatagaatgtccagtttgctctttaagtactgtcagttgagacctcctgactcatgtactactacacagactagagaatgcccatttatttttgtggttgattcaacacttccagatacagattgatacatatatacttattcattttgattcatgtaaaaggtttacatctaggggtgc

SEQ ID NO: 58660 - DNA, 215 bp, Homo sapiens
aactgtttgtttcaattggccatttaagtttagtagtaaaagactggttaatgataacaatgcatcgtaaaaccttcagaaggaaaggagaatgttttgtggaccactttggttttctcttttgcgtgtggcagttttaagttataagtttttaaaatcagtcactttttattggacacaccttgaccacacatttgtcacagattttgcggacc

SEQ ID NO: 58661 - DNA, 112 bp, Homo sapiens
gctgaggaataagaattgcttgaacttgggaggtggaggttgcagtaagccgagatggcactactgcactccagccagccttggggaatagagcgagactctgtctccagaa

SEQ ID NO: 58662 - DNA, 142 bp, Homo sapiens
gaaaagtattctttaattattctctgttatagtagagctgttcattatggatatttctgctgtcagtcacaatctaaattaattttggcaaagattgggtacttagttgcctgttaactgagttagctctaactctctggga

SEQ ID NO: 58663 - DNA, 204 bp, Homo sapiens
gaacttaaaattgagacaatcttgtgtttcctaaactgttacagtacatttctcagcatccttgtgacaggaagctgcaagaatggcacttttgattcatacagggattcttatgtctttggctacactagatattttgtgatttggcaagacatgtatttaaacaatgacctaaagggagataacttccacggtcacttgaaa

SEQ ID NO: 58664 - DNA, 172 bp, Homo sapiens
gtgaattgataagtaaaggcagaaaagattatatgtcatacctccattggggaataagcataaccctgagattcttactactgatgagaacattatctgcatatgccaaaaaatttttaggcaaatgaaagcttaccatttaaaggtacgggatcctaccatttaaaggtaa

SEQ ID NO: 58665 - DNA, 180 bp, Homo sapiens
gaagtgtgtttctgtgtggctaactctgggctagcgtgccgtggccattgaaggtgtggcctgcgtgggtgcagtgtaagtgacgctgggattgtcaggtggcagcaggggggcccttcctgtgtcagtgcttattgaaacaatggttggttggttcttaaaataaaaggccaaacaagg

SEQ ID NO: 58666 - DNA, 150 bp, Homo sapiens
aacagataaaaaatgaaattagtctattttctacttgccagcagagtatctgtcttattttaggatgcagtgtgacacttaccattcaactgaacaactaggttgtcaactaatgaaaataaaacaatttctcttaggcaaaagggaaaa

SEQ ID NO: 58667 - DNA, 253 bp, Homo sapiens
gcagtggacgagaaggctgctggagctggcaaggtcaccaagtctgcccagaaagctcagaaggctaaatgaatattatccctaatacctgccaccccactcttaatcagtggkggaagaacggtctcagaactgtttgtttcaattggccatttaagtttagtagtaaaagacttgttaatgataacaatgcatcgtaaaaccttcagaaggaaaggagaatgttttgtggaccactttggttttctttttt

SEQ ID NO: 58668 - DNA, 235 bp, Homo sapiens
aagtgattctaagatttggtttgggatcaataggaaagcatatgcagccaaccaagatgcaaatgttttgacatgatatgaccaaaattttaagtaggaaagtcacccaaacacttctgctttcacttaagtgtcttgcccccaatactttaggaacaagcatgatcttgttactgtgatattttggatattcacagtacttacttttttccaatgattctagtaaattgtccag

SEQ ID NO: 58669 - DNA, 145 bp, Homo sapiens
tttagtgtataaatatcaactgtcaattagaaaacaaaacacaaaacaatcactgcatacagtttcaggtaagacttatagtttgctatgcctttattctcattggtagagagcattttggtgatttactcatggtcacagaggg

SEQ ID NO: 58670 - DNA, 418 bp, Homo sapiens
atggccggggataatttagtgtataaatatcaactgtcaattagaaaacaaaacacaaaacaatcactgcatacagtttcaggtaagacttatagtttgctatgcctttattctcattggtagaaagcattttaatgatttactcatggtcacagaggaagtgtatccaagttacaattaaatttcaaaatattgaactagcttatatagagccaattttatcttgaatttaaaaacagttgtatagaatagagtcacataaagtatcaaagattgccttggttgtatatggaagataaaagccaggttcttacgcttaaaagaaatgttgatttatgttgaatttcaaaagaaatgattagattatccctgttgcctagttagcacaattgtctcagtgctctgaccttgggttggt

SEQ ID NO: 58671 - DNA, 220 bp, Homo sapiens
tgaagttaaacacaaaattatcagtgttttagaaacatgagtccggactgtgtaagtaaaagtacaaacattatttccaccataaagtatgtattgaaatcaagttgtctctgtgtacagaatacatactttattccatttttggaggatttgcttctggtgttccctaactagaatgtcagatgtttttgagttatcttccccattgtgcaagttgaac

SEQ ID NO: 58672 - DNA, 254 bp, Homo sapiens
ttcctgagggttttctcataaatgagggctgcacattgcctgttctgcttcgaagtattcaataccgctcagtattttaaatgaaggtgattctaagatttggtttgggatcaataggaaagcatatgcagccaaccaagatgcaaatgttttgaaatgatatgaccaaaattttaagtagggaagtcacccaaacacttctgttttcacttaagtttctggcccgcaatactttaggaccaagcatgatcttg

SEQ ID NO: 58673 - DNA, 212 bp, Homo sapiens
gctggcaacttagaggtggggagcagagaattctcttatccaacatcaacatcttggtcagatttgaactcttcaatctcttgcactcaaagcttgttaagatagttaagcgtgcataagttaacttccaatttacatactctgctttagaatttgggggaaaattaagaaatatatttgccaggattattggaattttttattaatgatta

SEQ ID NO: 58674 - DNA, 258 bp, Homo sapiens
gacagtggactagaaaaaatggctattggtcatcatatccatgaccgagctcatgtcattaaaaagtcaaagaacaagaagactggagatgaaggggtcaaccaggggttcatcaatatgaatgaaagggatgctcatgcttttcatgaggggtggcaagtgagggttttaaggacaaaaccaggcggcagaattttgggcacacactagattgagaggtgttggccatagagaatcctgggttcccgagagcttaaa

SEQ ID NO: 58675 - DNA, 215 bp, Homo sapiens
acaaaaattagagcacaaacccagtagaagagaattgttagaagagcagaagaatggctgaattgaaaaaaagtaaccacacttaaggcagtggttaaaagacttctttgactttaatgccatgatttctcaaataactcagtaggtacatttaaggtaagggtggggattattgacatctgaaattggaacattggtggcccaggtccgggaaa

SEQ ID NO: 58676 - DNA, 253 bp, Homo sapiens
atggccgggatcagacaaaaattagagcacaaacccagtagaagagaattgttagaagagcagaagaatggctgaattgaaaaaaagtaaccacacttaaggcagtggttaaaagacttctttgactttaatgccatgatttctcaaataactcagtagatacatttaagataaggatggtgattattgacatctgaattggtaaactggatgaccaggtgcagggaaaacgtcaaagcacaaaaaaaaaaaa

SEQ ID NO: 58677 - DNA, 262 bp, Homo sapiens
tttaaaatgaagtgaattcctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcacattttttcaaaagatcccagtaattgcctagaaatatctttctctta

SEQ ID NO: 58678 - DNA, 246 bp, Homo sapiens
aggtttctttcagggcattcaaaaaaatcaaagccatccggcttttcccaccaccattcggttctctttggcacaccaaaatcctatgtcaagtttccaggcatacagggtctttgcccaggctgttccagtggatgccctcctatgtttgcctttttcttatccccttggattgtctactgtgggctttaaattctgaatttccctcttacgctatcaaccgacgatgattctttttcctatgcc

SEQ ID NO: 58679 - DNA, 540 bp, Homo sapiens
atggccgggggatcacacgatttctttaagggaattaaaaaaaataaaagaattacggcttttacagcaacaatacgattatcttatagaaaaaaaaaatcattgtaaagtatcaagacaatacgagtaaatgaaaaggctgttaaagtagatgacatcatgtgttagcctgttcctaatcccctagaattgtaatgtgtgggatataaattagtttttattattctcttaaaaatcaaagatgatctctatcactttgccacctgtttgatgtgcagtggaaactggttaagccagttgttcatacttcgtttacaaatataaagatagctgtttaggatattttgttacatttttgtaaatttttgaaatgctagtaatgtgttttcaccagcaagtatttgttgcaaacttaaaggccattttccttaaagaatgggtacagctatgtaacccggtattattcctgggacggggctttattaaaaattacaaaccaggccaaaaaatttaaacccaaaacccttggaggttcctaaa

SEQ ID NO: 58680 - DNA, 251 bp, Homo sapiens
ttatatgctgttgatctatgggaaatctaggcgaaagtaatggggaagattagaagaattagccaaccaggctacagttgatatttacagatccatttaaacagcttgataagtgtttggtcaggcggtacattcttttccatccaaaaaggatttaacccttccacactctcttctctcacaattaatggaaactctgtatagggggaggtctgtatacagagagcacactcttcgtctccctctcctat

SEQ ID NO: 58681 - DNA, 249 bp, Homo sapiens
ttaaatgaagtgattctaagatttggtttgggatcaataggaaagcatatgcagccaaccaagatgcaaatgttttgaaatgatatgaccaaaattttacgtaggaaagtcacccaaacacttctgctttcacttaagtgtctggcccgaattactgttggaccaagcatgatctggttactgtgatattttatatatccacagtactcactttttccaaatgatcctagtaattgcctagatatatct

SEQ ID NO: 58682 - DNA, 263 bp, Homo sapiens
ggacaagagtgagacttctctcaaaaacaaaacaaaacaaaacaaaacaaaacagagttatatatgttccagaattcgaaattaagcatcaacatgataatcaaattaaaacttcataatgacctaggctaggattaattagtagatttccattaaaacattttcatgaatgtcatgagaggggtctatttaatccaatagagagatctctgtgttcttaacatgtgatatatatattgggggcgctctctagagtttacata

SEQ ID NO: 58683 - DNA, 421 bp, Homo sapiens
atggccggggggggacaagagtgagacttctctcaaaaacaaaacaaaacaaaacaaacaaaacaaagttatatatgtccagattcgaaattaagcatcaaaatgataatcaaattaaaacttcataatgacctaggctaggaataaatactagaatttcaataaaacattttcatgaatgtcatgaaaagatctatttaatccaataaaagattctgtgttttaaaattgtatattatttgtgactttctaagtttacaaaccagatttataaatttatcggtgactacaagtccttcttaaagcggattgggacatttcttctgaaattttgagtgctatcaaagttatcacctgtgttttgtacagttcatgtaaattgtacttcttgaaaatttcaaaaataaaaaagtagtttcta

SEQ ID NO: 58684 - DNA, 173 bp, Homo sapiens
gaagaagaattggccatcttaaaaagcgggtaaaaaacctcggttagggtgtgtgttcaccttcaaaatgttctatttaacactgggtcatgtgcatctggtgttggaggtttttcctcccctaggtaccaccattaaatgtttgtaattactactgaaaaaaaaaaaaaaaa

SEQ ID NO: 58685 - DNA, 256 bp, Homo sapiens
gaacagagaccagaaagagtaaaaccttttatgacaggggctgcagaacaaatcaagcacataccttgctaatattcaaaaactaccagttctttattggtgaaaccatgagtccagatggaatggttcctctatttggcctaccttaggaatggtttaaccccatatatgatttccttcaaggatggtttagaaatggaaaaatgttacacacatgtggcatttattttgggatctataaccttcataataaact

SEQ ID NO: 58686 - DNA, 256 bp, Homo sapiens
taaatgtgtacagggtccttttgcaataaaactggttatgacttgatccaagtgtttaacaacttgggctgttaagtctgaccatacatcactttgatagaatgtgggctttttcaagggtgaggctacaggtcttaaccacagtgtaactagacaggtkttcctttaaaaaaaaaaaacgggtaccccgggcgsgttttggattacacttttgtcaatttaatattgcctattgaatatatgcgcggtacacaca

SEQ ID NO: 58687 - DNA, 252 bp, Homo sapiens
gtttgaagtggaaaactggaagacagaagtacgggaaggcgaagaaaagaatagagaagatagggaaattagaagataaaaacatacttttagaggaaaaaagataaatttcaacctgacaagtaggaggcagaagacatatgccaggttaggatacatatagttatggccaaattgtccatccttdggaggggtttcggtagtatagtcacaggttagtcattgtacatttttgtcagggataccgtttgg

SEQ ID NO: 58688 - DNA, 258 bp, Homo sapiens
taaatgaaagtacacctacactaatagtctgtctcaacaatgagtaaaggaacttaagtattggtttaatattaaccttgtatctcattttgaggggatttaatatttccggcaaggatgttcaaaatcttccatataattaggtcacgggtaagcctgattgtctacgttcgaaacaaggtattatgacactatttcgccgcgcattacacaatcctaggtttatactagactaccatttatggaatacatagtgtt

SEQ ID NO: 58689 - DNA, 243 bp, Homo sapiens
gcatttagaggataatttaaagcacactctatagcagcttgtaaatgattaagtagtttaaccaaataaaccatttctgagtcagtcatctccagtaggtctattttagtctcaagataattcatttctggtgacacctgaagtcttagttatttgtaagtatatattggagacatttccactaaagcttagagcccactgggacatgaaagtaccatgttttttttcaagaccacatgtatt

SEQ ID NO: 58690 - DNA, 238 bp, Homo sapiens
ccaaccaagatgcaaatgttttgagatgatatgaccaaaaattttaggtaggaaggtcaccaaacattcctgctttcacttaggtgtctggcccgaatcctgtggggccagcttgtctctggtacctgtgtatatttaaaaataycacacagaccctcccttttcacaagtgacccgagaaattgcctagatatctctctctcttccctgatatatcccaatgtccccgggtttttat

SEQ ID NO: 58691 - DNA, 218 bp, Homo sapiens
tattttaaaatgaagtgattctaagatttggtttggggatcaataggaaagcatatccagccaaccaggatgcaaatgttttgaaatgatatgcccaaatttttaagtgggaagtcaccaacacacttttgctttcacttaggtgtctggcccgcattactgttgggcacaggcatgatcttgttaactgtgatatttaagatactccacagtactca

SEQ ID NO: 58692 - DNA, 242 bp, Homo sapiens
gttcggatgagaccaggtgttgcttgttcagtatctcaaggccagaaaagatggaattaatccttgaagggaatgacatttgagcttgtttcaaattcagcggctttgattcagcaaggcacaacaggtaaacacaaggatataagggaattttttggtgggatctatttctctttaaaaaggacctgttcaacaggcttaatgaataaggtctaaggggtacctggctacaggaagaaggg

SEQ ID NO: 58693 - DNA, 241 bp, Homo sapiens
gtggttttcagtttagctacggcaatcctgaacttcctgaagatgtccttgatgtgcagctggcattccttcgacttctcttcagccgagcttcccagaacatcacatattacttcaaaaatagcatttcatacattgatcaggcagttgaaatgtaaagaggggccttaagcttattgggtcaaattaaggtttaattcaaggcttgaaggaaatagcaaattcacctacacagttcttg

SEQ ID NO: 58694 - DNA, 237 bp, Homo sapiens
gcctatttcatcacaagaacacacacatatacacgaatagacatcaaactcaatgctttatttgtgaattgagtgttttttgatttctactgtcaaatgatgtgcaaaaccttttactggttgcatgggaatcagccaagtttttatgatccttgggtcttaatgttccccagagcttgggtttaaatacatgtggatgttactctcttgcaccaccttatcttgatacaacaaatt

SEQ ID NO: 58695 - DNA, 181 bp, Homo sapiens
gtgtttaacgcttgcttgtaatttctgggctctcatatacttctcagataaccgcaatggaggatagatagataaggatacacaaaacaatggctcaaatgtttctcttcaaaaataaaacagattgatttggaaaaccctccccgcgagccacaaaaaaagggccccgttttcccttccg

SEQ ID NO: 58696 - DNA, 377 bp, Homo sapiens
atggccgggggttgaattagtttgcaaactatataaagacatatgtagtaaaaagtctgttaatgcacatcctgtgggaatggagtgttctaaccaattgccttttcttgttatctgagctctcctatattatcatactcagataaccaaattaaaagaattagaatatgatttttaatacacttaacattaaactcttctaactttcttctttctgtgataattcagaagatagttatggatcttcaatgcctctgagtcattgttataaaaaatcagttatcactataccatgctataggagactgggcaaaacctgtacaatgacaaccctggaagttgctttttttaaaaaaataataaatttcttaaatcaa

SEQ ID NO: 58697 - DNA, 170 bp, Homo sapiens
taacatggctttggaaatatttcagttttctctgaccaactcgtttatcacctagccgtcacatagatcacaccaagaagctgattgatttacggtcacatttctttcatgttgctttggaaaagatactgaaggctcgggcaacataatgagaacccgtctctacaaaa

SEQ ID NO: 58698 - DNA, 239 bp, Homo sapiens
aattagagataaaacatactttagagaaaagataattaaactgaaagtagaagcagaagaaaaagacagtaggaacaaaagttaagggcaaatgtacaaacttagagaaaatttgaggatagaaacaagatagaaaatgaaaatattgtcaagagtttcagatagaaaatgaaaaacaagctaagacaagtattggagaagcatagaagatagacacatattaagccaaaaaaaaaaaa

SEQ ID NO: 58699 - DNA, 178 bp, Homo sapiens
gatataagttcttgatgttaagatgaatgatattatatggaatttgctagatagatcaactctacaaagattgttcgaaaggggaggataagtctcttcggaggtgattttaggtaggaaatttggcggtaattttaatcaaaaatcggtttattaaaaatgaggcccttatataggt

SEQ ID NO: 58700 - DNA, 359 bp, Homo sapiens
atggccggggtagaatgtaaagcttgtctgatcgttcaaagcatgaaatggatacttatatggaaattctgctcagatagaatgacagtccgtcaaaacagattgtttgcaaaggggaggcatcagtgtccttggcaggctgatttctaggtaggaaatgtggtagcctcacttttaatgaacaaatggcctttattaaaaactgagtgactctatatagttgatcagttttttcacctggaagcatttgtttctactttgatatgactgtttttcggacagtttatttgttgagagtgtgaccaaaagttacatgtttgcacctttctagttgaaaataaagtgtatattttttctat

SEQ ID NO: 58701 - DNA, 245 bp, Homo sapiens
tctgcagtaatatgtatatcatctattagaatttacttaatgaaaaactgaagagaacaaaatttgtaaccactagcacttaagtactcctgattcttaacaattgtctttaatgaccacaagacaaccaacagctggccacgtacttaaaattttgttcccacttgtttaaaaatgttacccgtgtaatttccatccggttatatatatgaggtggcgtgtaccttaaatgcgcaatatgtgat

SEQ ID NO: 58702 - DNA, 268 bp, Homo sapiens
tgattggattgtttgaaagagatttaaagtttcaaagttttttgttctgtttttgctttgcatttggagaaaatattgaaagcagggtatgttgtttcattcaccttgaaaaaaccatgagtaaatggggatatagaatctctgaatagctcgctaaaagattcaagcaaggggcatgaattttgttccacctatccaataattatccagagggccaccttttttaaggggctctatgcgcaaaaaaaaaaaaaaaaaaaaaaaaaaa

SEQ ID NO: 58703 - DNA, 332 bp, Homo sapiens
gtaggagttgaagccaaacagccaaattctgccattaggaggtgtgtaagggtccagctgatcaagaatggcaagaaaatcacagccttttgtacccaatgacggttgcttgaactttattgaggaaaatgatgaagttctggttgctggatttggtcgcaaaggtcatgctgttggtgatattcctgggggtcccctttaagggtgtcaaagtaggccaattttctctttttgggccctatacagggcaaggaggggaggccccgctctcatatatttatgggtgaacacactgggtatatattttcacatacccaaaaaaaaaaaaaaaa

SEQ ID NO: 58704 - DNA, 233 bp, Homo sapiens
gaaaaatgttaacaaatgtggcaattattttggatctatcacctgtcatcataactggcttctgcttgtcatccacacaacaccaggacttaagacaaatggggactgatgtcatcttgagctcttcatttattttgactgtgatttatttggagtggaggcattttttttaagaaaaacatgtcatgtaggtttgtctaaaaataaaatgcatttaaactcaaaaaaaaaaa

SEQ ID NO: 58705 - DNA, 191 bp, Homo sapiens
gatcggtgacatcgtcacagtgggcgagtgccggcctctgagcaagacagtgcgcttcaacgtgctcaaggtcaccaaggctgccggcaccaagaagcagttccagaagttctggaggctgggacatcggccccgctcccccacaatggaaataaagttattttctcattcccaaaaaaaaaaaaaaaaaa

SEQ ID NO: 58706 - DNA, 257 bp, Homo sapiens
cattagagcatctctgcaagaccaaaggaagaagaaaagggccaaagccaaatgaactgatggtacttgttttcaccattgggctaactttgctgctaggagttcaagccatgcctgcaaatcgcctctcttgctacaggaaggttcttaaaggtcacacctgtcacaaccttccgggaggggtagctgccctgccaaaggttggtgtctaattccccgggtccattcttgggatggggaggggttgtgagttgctt

SEQ ID NO: 58707 - DNA, 164 bp, Homo sapiens
tgtgcgtacgtgtatataactgaagtgtctgtacggactgccctttgctagccatgggctggtcaccagattgttttgtaatgcccgccccttgcctcgatattgccagtttcttgtgcaataaactatcagcagctaaaaaaaaaaaaaaaaaaaaaaaaaaa

SEQ ID NO: 58708 - DNA, 320 bp, Homo sapiens
agcatttaagaagcatcctctgccaagaccaaaaggaaagaagaaaaagggccaaaagccaaaatgaaactgatggtacttgttttcaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctcttctgcccaaaagacggtttctttgg

SEQ ID NO: 58709 - DNA, 232 bp, Homo sapiens
agtaggacagtcacccaaacacttctgctttcacttaagtgtcttgcccgcaatactttagggacaagcatgatcttgttactgtggtattttggggtatccacaggacttacttttttcaaatgattctagtaattgtctaggatatctcttctctctcccctttatttatcagtgtgtgccccgtgtttttatacggggggcgcgtgtagtttgggggcacttttgggtg

SEQ ID NO: 58710 - DNA, 254 bp, Homo sapiens
gccattttgctggctataagccgggtcttcgaaccaaagggagcacacagctcttgttgaaaattggaagggttttacggcccagatagaaacagagtgttatattgtgggcaaagatatcgctttatatgatgatgatgaggcgcagagcacacacaaagcacaactgcgcgggggggacaccacaacacaaaccacagggatcatcgggaggaagtgtctcccggcccccagagacacaggcagcaggagcg

SEQ ID NO: 58711 - DNA, 443 bp, Homo sapiens
atggccggggggaacgggacttctaaaaggaactatgtctggaaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaacaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtgatgctgtacccctcaaggatttaaactaacgaaaaatcaataaataaatgtggatttgtgctcttgtatttttaagtggattaaaaaacttactacctta

SEQ ID NO: 58712 - DNA, 247 bp, Homo sapiens
  misc_feature 218: n = A,T,C or G
tcattttctctccatgttctttctcacttttatacggtaatacttatattgataaaggattaagttttattataaaatgtttttgagaaagtatatacaaagaacccgcgtatatactctaaaggtatatgagtgaaaactttcttgaccccttgttctcacagcacttctagttttacacccataagcgacacagtcccctatgtttctacaacttncttgttcccccattaaacactgtatctct

SEQ ID NO: 58713 - DNA, 396 bp, Homo sapiens
taccgggaattcggccattatggccgggggtattcaggatgaaaatgttcacgctgcattaattgtcatttttctctcccatgttctttctcactttgatacgttaatactgataatggataaagagtgagtttttataataaatggttttggaaaggtattcataggaaccgcggttatttacttaaggttatggagtaaactagcttggaccttgggctgcaggacgactaggattcacccataacgacacagtgccctatgtttcttaacttcttgttgccatttgaaactctgtactcttatgtttaaagggttctgtatagccattttttttttcagaaagttacattgctttgtatagaaataaaaggcattattaaaatttgcttgtta

SEQ ID NO: 58714 - DNA, 190 bp, Homo sapiens
  misc_feature 163: n = A,T,C or G
agaataattcaagtgatgaaaacaggaggaccattccaccaaaaaggggtgaaggcaacaagtaaaagatttgcgcacgcgaaatatgcctacagctttatagagggagagacacacccgtttttagagtcccgcaccacatacactatattcccacatcacnacacagagggctcgggtctcgtagaga

SEQ ID NO: 58715 - DNA, 452 bp, Homo sapiens
atggccggggttttaagaaagtttacagatttgtgttgggctgcattcaaagctgttctgggctgcattagacccgtgggctagagttggacaagcttgtagatgatttcaggttataaaaccagaagtacaattcaacaaaaaaggagtaagtcatcaatataaatattagcaaacgagatattgctacatctctatttaaagtaagatacaaccgattttaaagttcctgaaaccatagccatattttgacatttcacaaagaatggttctagtctactagagtacatttggctaagtagataacttacctaaatttgctccaaagctaaatcacaagtaaacatatttatgtttaaaacacagaaataaataacttaagatttttatctaagcggtcagtgttgtgttggaaagatatatctataaataaactttggactgattccacc

SEQ ID NO: 58716 - DNA, 282 bp, Homo sapiens
  misc_feature 252: n = A,T,C or G
aatgtggggttcatatagctttggaagcgtcgtcacaggvccaagmmcaaattgcatctsatggtctcagggtcgtgtgttgrmgcgagtcttkctkgwtttscagrattgatkgaggtgccwttcggamamtccaggctgtttcytgaggtgtgtccaggkwaaaammctscyctgctctactttcchggghkggtactctymcccgtgacarwgtgtgtcccatggwcaaaatatgcgcagacagtgttntacgacgctcccgttttttgtcgagtttcc

SEQ ID NO: 58717 - DNA, 657 bp, Homo sapiens
atggccggggttcaatataagaaatattggaaagacgctcgtcaccaggacccaaggaaccaaaattgcatctgatggtctcaagggtcgtgtgtttgaagcgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacgggagacctcttatgctcagcaccaacaggtccgccaaatccggaagaagatgatggaaatcatgacccgagaggtgcagacaaatgacttgaaagaagtggtcaataaattgattccagacagcattgggaaagacatagaaaaggcttgccaatctatttatcctctccatgaagtcttcgttagaaaagtaaaaatgctgaagaagcccaagtttgaattggggaaagctcatggagcttcatggtgaaggcagtagttctggaaaagccactggggacgagacggtggctaaagttgaacgagctg

SEQ ID NO: 58718 - DNA, 265 bp, Homo sapiens
ccaagttttataattcttaaatcttaatgtttctcagagctttgattaaaatacatataggtgtaactctcttgcaacccaattatcttgatacaatcaaaatttgtctctggtaaaaaaaccatggggtggatggtatatgagagccccagagaaattttcacacacatcacatgggcgctcacatcccactcaagagggggtatttcagagaaataggggttgcagcagcacccccccccgaggaggacccctttctcgacga

SEQ ID NO: 58719 - DNA, 379 bp, Homo sapiens
atggccggggctgtcaaatgatgtgcaaaaccttttactggttgcatggaaatcagccaagttttataatccttaaatcttaatgttcctcaaagcttggattaaatacatatggatgttactctcttgcaccaaattatcttgatacattcaaatttgtctggttaaaaaataggtggtagatattgaggccaagaatattgcaaaatacatgaagcttcatgcacttaaagaagtatttttagaataagaatttgcatacttacctagtgaaacttttctagaattatttttcactctaagtcatgtatgtttctctttgattatttgcatgttatgtttaataagctactagcaaaataaaacatagcaaatggca

SEQ ID NO: 58720 - DNA, 249 bp, Homo sapiens
agagccctattgtgccttacctggtgtgtcttttgtgggcaccttgttttatgaaggataaaagatgatttgttatcttaaggggataaattttaaaatcttaagttatggcttagagagctaacgtgttaaaatatataatatatatggagagagaggcgcgcgccccggctgcttccctgatatttatttgtgaaaagcagagagattatactgcggagctgagagcccccccatctttaaacccct

SEQ ID NO: 58721 - DNA, 572 bp, Homo sapiens
atggccggggcacgttttctggttaagtaaacatgatgcacactattctgtaacagaaagccctattgtgccttacctgtgtgcttttgtgggcaccttgtttatgaagaataaaaaatgatttgttatctgaagagaataaattttaaattctcagtttatgtctcagatgctaacgtgtgaaaatataaatatatataatatataaagtaaccagtcttcctgtattttatgtgcatcaaagtgatttatctgagcttagtgacccccatcttgtaacctgttgcaagagtgaatgtaaaaaatagttgtggaatttaaaaggtcgcctttgatgcagatgcatctttttcttgcttctaaaacatatttcatgtaaacattgtacatttattattggtatatatactaatatgcagcttattttacctgaaactggtaagccgaccaaggtccctccttgcaagacaagatgggaatgtgtataataaccaaggtatttggagaaagtccggaagtttggatggtaaaccggttaccttggccctgggtaaaaaaaaaagaaaaaaaaa

SEQ ID NO: 58722 - DNA, 254 bp, Homo sapiens
ttaatattgccatttaaatttggtgtaacaattggttacaattgtttttcaaagctatcctttgaggagaaagtcaaaatgtgttgttagcctacccccactcaaggctcttgctgtgtaatcaatatttcagggtatgatgtcccatagggtttaaaactcgcgtgtactcattattctgctctcttcccataccctctgtcactagtatattagagaccctaacttatagcgcaagagccacgcaggctgca

SEQ ID NO: 58723 - DNA, 277 bp, Homo sapiens
gagtgatgttagcagacccagcttagagttcttctttctttcttaagccctttgctctggaggaagttctccagcttcagctcaactcacggcttctccaagcatcaccctgggagtttcctgagggttttctcataaatgagggctgcacattgcctgttctgcttcgagtattcaataccgctcagtattttaatgaagtgattctaagattgttggatcatagaagcatatgcagccaaccaagatgcaaatgttttgaatgatatgaccaaaa

SEQ ID NO: 58724 - DNA, 129 bp, Homo sapiens
aggcaagagttaagatagctgcaacatagtataccctattttaaaaaagaagaagtttttaaatttgcaaataataataggtcattggatttatcaaatgcttttcttcgctcttttgagatgagtact

SEQ ID NO: 58725 - DNA, 368 bp, Homo sapiens
atggccgggatctgaggccaagagttcaagatcagcctgggcaacatagtgataccctatctcttaaaaaagaagaagtttttaaatttgaaataataataggtactggatttatgcaaatgtcttttctgcgtcttttgagatgagtatcaggttttttttttttccttttaccaccggaggaggaacttaaggttcccatttgtattaagggaatacaaagtccctcggtgatttctgaaccaagctattcctaggcggagttttatttggttgacacagaaataaattaaaaggccaagcgtggggcatgtgcctgtactccaaattgctgaggtaagaggattgcttggacccagggttcaagg

SEQ ID NO: 58726 - DNA, 127 bp, Homo sapiens
atgaaattctgaattaatgaaactggaaaactttatagattacttattatcttggatttatggtgttattaaacatgctgaccatatttccttcatcctcttgttcctaagggaacaaaaacaggaa

SEQ ID NO: 58727 - DNA, 141 bp, Homo sapiens
aagacaatcattgaatacaaaacaaataagccatcacgctgcccttccttgatattgcacctttggacatcggtggtgctgaccaggattctttgtggacattgccagtctgtttcaaataaatgaactcaatctaattaa

SEQ ID NO: 58728 - DNA, 219 bp, Homo sapiens
acaaaggtgctaattaatagtatttcagatacttgaagatgttgatggtgctagaagaatttgagaagaaatactcctgtattgagttgtatcgtgtggtgtattttttaaaaaatttgatttagcattcatattttccatcttattccaattaaaagtatgcagattatttgcccaaagttgtcctcttccttcaggatcagcatttgttctttgcca

SEQ ID NO: 58729 - DNA, 202 bp, Homo sapiens
aagcttttcttattcttttattcttaagatcagtatcttcttacagtattctttctacatgatccttttttgtacatttaagaatattttgattatattacacaagactgctgattttgctactttttttaaggggtcttcaagtaagtaaaacatacatcgtagctagagaaaatgtacctaaatttgcaatcttccctct

SEQ ID NO: 58730 - DNA, 143 bp, Homo sapiens
gaaaaataaagaagagctgcagaatatgctaaactttggccaagagaatgaaggaggctaaggagaagcgccaggaacaaattgcgaagagacgcagactttctctctgcgagcttctacttctagtctgatccagtcaagaa

SEQ ID NO: 58731 - DNA, 143 bp, Homo sapiens
gaaaaaattgtattgaaaacactcagtatgcagtctataagaggaatttggtataattatggtgggtcattattttccatactgtatgtgccaaagctttactactgtggaagacaactgttttcataaaagatttacattcc

SEQ ID NO: 58732 - DNA, 358 bp, Homo sapiens
ggtgcagcagtggtaccagcagtttctctacatgggctttgacgaggcgaaatttgaagatgacatcaccctattggcttaacagagatcgaaatggacatgaatactatggcgattactaccaacgtcactataatgaagactctgcaattggtccccggagcccctacggctttaggcatggagccagcgtcaactacgatgactactaaccatgacttgccacacgctgtacaagaagcaaatagcgattctcttcatgtatctcctcaatgccttacactactttgggtctgatatgctctatttcagcagatcttttctacctactctgtgtgatcaaaaaaaaaaaaaaaaa

SEQ ID NO: 58733 - DNA, 179 bp, Homo sapiens
atgaaggtaacttgggttttgcttgtttgtattggataaccatttaagccaacttcagtttctctgcctttttttctgtagtttaaccatttctaattttgttcatattctaaatagatgttagactcatactttttattttctactttctaaataaattatctaaggtgtttactaaa

SEQ ID NO: 58734 - DNA, 236 bp, Homo sapiens
agggaatgtgaaatttacatcatttctttttgggagagacttgttttggatgccccctaatccccttctcccctacactgtaaaatgtgggattatgggtcacaggaaaaagtgggttttttagttgaattttttttaacattcctcatgaatgtaaatttgtactatttaactgactaatcttgaatgtaaaatcttgtcaagtgtattaaaataaaaccggtacccaatttaaa

SEQ ID NO: 58735 - DNA, 207 bp, Homo sapiens
tttgaaatgatatgaccaaaattttaagtaggaaagtcacccaaacacttctgctttcacttaagtgtctggcccgcaatactttagggacaagcatgatcttgttactgtgatattttaaatatccacagtactcactttttccaaatgatcctaggaattgcctagaaatatctttctcttacccgtgatttatcaatttttccc

SEQ ID NO: 58736 - DNA, 180 bp, Homo sapiens
ctacattctcttcaggaaaacaaactacagtgtccagtggctatattttggtcccttctatctttttttctgctcctctagtagaaagaggtggattgagatggatcactatttaggacttgcacagcttcagggggacggtacctcaaccatcaaaagggaaaacactttatgttataa

SEQ ID NO: 58737 - DNA, 510 bp, Homo sapiens
atggccggggggtggaactacattctcttcaggaaaacaaactacagtgtccagtggctatatttttttcccttctatctttttttctgctcctctagtagaaagaggtggattgaaatggatcactatttaaaacttgcacagcttcaggagacgatacctcaacatcaaaagaaaaacactttatgtataaaaaaattttttgaaatacagcccttcaaagaatactgttctgtcctgtgtgtatattgagtttttgctctataactgatttgacaacatcaacttatttcatgattaaatgaggttgtaaactttcattacatttatttccttgggaaaaacaaagggatgggaatactcctccttgttcagtggaattgctaggtcctaaccaagatggataatcttaacttttggttacacaatgtttcaagcatccattttgtcatatagagaattcctaaataattctaagtgaatgaaagaattgtgttgtgaaatggttga

SEQ ID NO: 58738 - DNA, 270 bp, Homo sapiens
aaaatcttgttaatgtcattgctaaaggataaataagagctagatactggaaacctaactgcaatgtggatgttttacccacatgacttattatgcataaagccaaatttccagtttaagtaattgcctacaataaaaagrrattttgcctgccattttcaggaatcatcttttgaagctttctgttgatgttaactgagctactagagatattcttatttcactaaatgtaaaattttgagtaaatatatatgtcacaaattttagtga

SEQ ID NO: 58739 - DNA, 153 bp, Homo sapiens
aaattgtattgaaaacacttagtatgcagttgataagaggaatttggtataattatggtgggtgattattttttatactgtatgtgccaagctttactactttggaaagacaacttttttaataaaagaatttacattccacaaaaaaaaaaa

SEQ ID NO: 58740 - DNA, 227 bp, Homo sapiens
taaaataataaagctagatactggaacctaactcaatgtgatgttttacccacatgacttattatgcataaagccaaatttccagtttaagtaattgtctacaataaaaaggaattttgccttccattttcaggaatcatcttttgaaggtttctgttgatgttaactgagctactagagatattcttatttcacttaaatgtaaaaatttgagtgaaatatatatg

SEQ ID NO: 58741 - DNA, 271 bp, Homo sapiens
gtttgggatcaataggaaagcatatgcagccaaccaaggatggcaaatgttttggacatgatatgaccaaaattttaagtagggaagtcacccaaacacttctgctttcacttaagtgtctggcccgcaatactgtgaggaacaagcatgatcttgttactgtgatattttgaatatccacagtactcactttttccaaatgatcctagtaattgcctagaaatatctttctcttacctgttatttatcaatatgtcccagtatttttata

SEQ ID NO: 58742 - DNA, 224 bp, Homo sapiens
aaagcagagttttaacctgacggcatggaatgtataaatgaggggggggtccttctgcagatactctaatcactacattgctttttctataaaactacccataagcctttaacctttaaagaaaaatgaaaaaggttagtgtttgggggccgggggaggactgaccgcttcataagccagtacgtctgagctgagtatgtttcaataaaccttttgatatttaa

SEQ ID NO: 58743 - DNA, 208 bp, Homo sapiens
taaaggcacaaatttctgtttaatacttgtgtcagcctctgtaatctctttataagttaactaatagatctattttcttcagacttctgcaatagttctttaaaatcacaacagttagcaagctgacttttgtaatgtgctcaatacaaatacttgtgaacttttaatatgttgagtgctttcattttgataactgggtctccatttg

SEQ ID NO: 58744 - DNA, 130 bp, Homo sapiens
aaaaatggttatttttagtgggttttaatatgtgaaaaaaataaaattagctatttgccaaaaatgtttttatgtgtttatatatacttggttcttgttacttgcaaatgattaataaaaattttaaggg

SEQ ID NO: 58745 - DNA, 267 bp, Homo sapiens
tccctttgccaagccatcctggatgaaaccaaaggagattatgagaaaatcctggtggctctttgtggaggaaactaaacattcccttgatggtctcaagctatgatcagaagactttaattatatattttcatcctataagcttaaataggaaagtttcttcaacaggattacagtgtagctacctacatgctgaaaaatatagcctttaaatcatttttatattataactctgtataatagagataagtccattttttaaaaatg

SEQ ID NO: 58746 - DNA, 273 bp, Homo sapiens
gaaacaggcccaagtgcatactcgggttctttccaactcagaatcatctctgattccacaaaagtgagtttagtttcctatctgaattaacaactttaaaggagactataatagttaagagtggaagaatagaaataaataaatttgggatgacgattcgattaaagtagaagagaagggttctgttccatgtacgattaatgtgccccttttggagataagctttccaaaatatgcgtatgagcaaaattagagagttccaccactaagcaa

SEQ ID NO: 58747 - DNA, 271 bp, Homo sapiens
aaaagattgtgtgtatgtatgtttaatataacatgacaggcactaggacgtctgcctttttaaggcagttccgttaaggggttttgtttttcaaacttttttttgccatccatcctgtgcaatatgccgtgtaggatatttgtcttaaaattcaaggccacaaaaacaatgtttgggggaaaaaaaagaaaaaatcatgccagctaatcatgtcaaggttcactgcctgtcagattgttgatatataccttctgtgaataactttttttga

SEQ ID NO: 58748 - DNA, 127 bp, Homo sapiens
ctgaggtggaaggatcacttgagccctagagctcaaggctacagagagctataattgtgccacttcacttcagctggggtgacaaagcaaggctctcttaaaaaaaagaaaaaaaaaaaaaaaacat

SEQ ID NO: 58749 - DNA, 138 bp, Homo sapiens
atggccgggggagggctgaggtggaaggatcacttgagccctagagctcaaggctacagagagctataattgtgccacttcacttcagctggggtgacagagcaaggctctcttaaaaaaaaaaaaaaaaaaaaaaaa

SEQ ID NO: 58750 - DNA, 267 bp, Homo sapiens
aagttgagattcaaatacagcagctctaattttggtaatctgtgcaatttgaatacaataatttccctcttgaaaattaagggcacttttcatggtatactttactctcatttcgccagttgacaactctcaaccatcataccataaattgtgcactgtgttcctaagtaccagcatttttcatatgttgaacagagcctgttcgttgattgttgtgtgatcctgagagtaattagcttaactacttacccttaggctgtatctctt

SEQ ID NO: 58751 - DNA, 596 bp, Homo sapiens
atggccggggtagacaaagttgagattcaaatacagcagctctaattttggtaatctgtgcaatttgaatacaataatttttttcttgaaaattaagggcacttttcatggtatactttactctcatttcgccagttgacaactctcaaccatcataccataaattgtgcactgtgttcctaagtaccagcatttttcatatgttgaacagagcctgttcgttgattgttgtgtgatcctgaaagtaattagcttaactacttacccttaggctgtatctcttcttgatggcaaaacattagaaacatagtgaatgttttgattagaatgttttgatgggccaatgtattttcccacacaacagttgtttaaatagacaatggtgaccagcacagatgaagaaggggaggtgggcagctctccattagaccagagtttatcagcttgttgatgtgactttggggataagagattttccccgtgggaaaaagcaagaggaggacctaactcctgaaggggaagggttgggctaagtggcaactggcaaaaaggtccaaataaggccaacggtgggcccaatggtacccctaatggtt

SEQ ID NO: 58752 - DNA, 253 bp, Homo sapiens
cttcacatattttatcttatatagttcatagatatatcacataaaaagatatttcatatctcattttactatccaaaaagttcgaagggaaactttctggttcttttccccctcccgctcgatcccgaaagagcgcgagcgctcgatatatcgcgatcgcgggagatatttcttgcgcccacttttgagttcctttgagagcgccgaaatagcccgaaatataaagatctttcccgatatatttttcgagcgc

SEQ ID NO: 58753 - DNA, 610 bp, Homo sapiens
atggccggggttccaaaaactttgaaaagctaaatgtttcccatgatcgctcattcttcttttatgattcatacgttattccttataaagtaagaactttgttttcctcctatcaaggcagctattttattaaattttttacttagtctgagaaatagcagatagtctcatatttaggaaaactttccaaataaaataaatgttattctctgataaagagctaatacagaaatgttcaagttattttactttctggtaatgtcttcagtaaaatattttctttatctaaatattaacattctaagtctaccaaaaaaagttttaaactcaagcaggccaaaaccaatatgcttataagaaataatgaaaagttcatccatttctgataaagttctctatggcaaagtctttcaaatacgagataactgcaaaatattttccttttatactacagaaatgagaatctcatcaataaattagttcaagcataagatgaaaacagaatattcctgtggtgccagtgcacactaccttcccacccatacacatccatgttcactgtgacaaactgaatattcacaataaagcttctgagtaacaaaaaaaaaaa

SEQ ID NO: 58754 - DNA, 152 bp, Homo sapiens
gcctttgtaaaattgacagagaggggaaaccccgtaaagtggttggttgcagttgtgtagtagttaaggactatggcaaggagtctcaggccaaggatgtcatttaagagtatttcaaatgcaagaaatgaagaaataaatctttggctcac

SEQ ID NO: 58755 - DNA, 220 bp, Homo sapiens
aagacaaatcattctttgtaagaacaaaggtaaagtgccagccacgtcttacgtattattttaattgctgattttagttttagaaataataaatttagcatattagccatcaaaaagaaatcatggtattacatagtatttacctttcacagcttagtctttatcttcatactaaatgttttcctgcaggatcttccatttgtactatatttgggaatta

SEQ ID NO: 58756 - DNA, 152 bp, Homo sapiens
gcctatttcatcacaagaacacacacatatacacgaatagacatcaaactcaatgctttatttggtgaatttagtgtttttttatttctactgtcaaatgatgttccaaaaaccttttacttgtttacactgggcattcagccaggtttttw

SEQ ID NO: 58757 - DNA, 110 bp, Homo sapiens
gctggaacggaagaattgcttgaacctgggagatgggaagttgcagtagctgagattacgccatttcactctagccttggcaacaagagtcacactccattttcccccca

SEQ ID NO: 58758 - DNA, 169 bp, Homo sapiens
tcaaggcccacaggcagtaaggaggtttggggaaaggacttttactgtctttgtttcaaaaataaactataaactaaggttctccaaaagttaggttgggcttatttccagggattaacaaggacaacttgagataaagagcaagggggagtcaattagggcaaatctc

SEQ ID NO: 58759 - DNA, 151 bp, Homo sapiens
tacccacttttttccaaatgatcctagtaattgcctagaaatatctttctcttaccctgttatttatcaatttttcccaggatttttatacggaaaaattgtattgaaaacacttaggatgcaggtgataagaggaattttggataattat

SEQ ID NO: 58760 - DNA, 246 bp, Homo sapiens
gactttcggtcttggttatatgtgagaattctgaatcccaaacccctgcgtttaggtaggtagaaggaggatgcctaatcctacaaagtgaccccttatacaattcaatttttatttgatattaaaggatgagatagagttgtagagacaattaattatcccctctttacacacaaaacacacatatctctccacatacctctcccccccaattttacacagagatatctcgagagtaaaaccccc

SEQ ID NO: 58761 - DNA, 138 bp, Homo sapiens
aagtataatagaaataatctttagttgctcttttctaaccattgtaattcttcccttcttccctccacctttccttcattgaataaacctctgttcaaagagatttccttcaagggaaataaaaatgactaagatatt

SEQ ID NO: 58762 - DNA, 223 bp, Homo sapiens
gaaaacttgatttccaccaaccgcctaccctaaaatcaggaacacccacctaccttaatttacaataataatatacaatggaaaaattgacaattcaaaaggaaacaattaaatacaaaacaaacctacaattttttaaggaggtggtagagaagcctaatccctaattcccaatccttcaattgccatttttaacctacgggttaaggttatcccctccagg

SEQ ID NO: 58763 - DNA, 286 bp, Homo sapiens
atggccgggggactgcaaagtcccttctgttgtgattcctaggacttttcctcaagaggaaatctggatttccacctaccgcttacctgaaatgcaggatcacctacttactgtattctacattattatatgacatagtataatgagacaatatcaaaagtaaacatgtaatgacaatacatactaacattcttgtaggagtggttagagaagctgatgcctcatttctacattctggtcattagctattatcatctaacgtttcagtgtatccttacagaaataa

SEQ ID NO: 58764 - DNA, 189 bp, Homo sapiens
tttggaatgcaaaattaattgttttaccctcaagctgggaatatttttcaaaataaatactataatatagatatcaaattattacctccccatgttatgttgaaaatatttttattaaattgataaaactttatttcccttatattcataatgttctgttatacatacacattaaaatgttcagtaaaa

SEQ ID NO: 58765 - DNA, 339 bp, Homo sapiens
ggcaaaagaaggatggttttggagctaaaagcagggactaggaatgatttctccccaaggtcacctggatccatcttatttctgcaccttcccctctttcatgatggatactcgacccttgaaccattcaagaaggagacattccaccttattgtatcccctaaaaggaacacacaactcaggggtaattttggcttctaccaggagaaaaaggataaccattgaggccactaaaggttagtgatatcactcgatattttcagtgtatgcacagagagaggcagtgtgctctatatgggattacactcttagcacggataaagagagaaaaggtatctg

SEQ ID NO: 58766 - DNA, 269 bp, Homo sapiens
atggccggggaaaggcaaaagaaggatggttttggagctaaaagcagggactaggaatgatttctccccaaggtcacctggatccatcttatttctgcaccttcccctctttcatgatggatactggacccttgaaccattcaagaagaacattccaccttatggtacccccaaaaagaaacacaaccgaagggttattttgattcctccaaggagaaaaagaataactatttagaccaataaagtgaagtatttccattgaattttta

SEQ ID NO: 58767 - DNA, 135 bp, Homo sapiens
catatgaaatataaattatctgaatattagatgctctgagaaattgaatgtaccttatttaaaagattttatggttttataactatataaatgacattattaaaggtttcaaatattttttaaaaaaaaaaaaaa

SEQ ID NO: 58768 - DNA, 377 bp, Homo sapiens
atgagattttttaagggctttatgtgaactatgatattgtaatttttctaagcatattcaaaagggtgacaaaattacgtttatgtactaaatctaatcaggaaagtaaggcaggaaaagttgatggtattcattaggttttaactgaatggagcagttccttatataataacaattgtatagtagggataaaacactaacaatgtgtattcattttaaattgttctgtatttttaaattgccaagagaaacacactcttgtaaatttggagatattttccccacagcttttcgtcttcagtgtctcaatgtgggaggggacccccaccacacacagggagttggcacaaacagacttctggcgcacccttttaaat

SEQ ID NO: 58769 - DNA, 286 bp, Homo sapiens
aaagttgaccaaggaacactttttgaactcattctggctgcaaactacttagacatcaaaggtttgcttgatgttacatgcaagactgttgccaatatgatcaaggggaaaactccygaggagattcgcaagaccttcaatatcaaaaatgactttactgaagaggaggaagcccaggtacgcaaagagaaccagttgtgttaagagaagtgaaatgttgtgcccccacactttaacactgtaagggatgttccacatactatgttggcactctctctttataaat

SEQ ID NO: 58770 - DNA, 329 bp, Homo sapiens
taaatagtttggaagagggttggattatcattacctttacaatactgtataatcagaagttctctgaacctcaattgtatatctagacataaaaattgttttctgtataggatgttgtttgggttgtttctgagtgtttaaattttgcaaaaacaaatgttaaatttatgcttcagtacctcaggtaaattgggaaggttaatgttctagtttctgggaggtaagccttggagacaaataaagccattcacttctatagtttagttgatagtaaatgacggggactccctcattatttccagggtttactctcccccaagagggcgaca

SEQ ID NO: 58771 - DNA, 310 bp, Homo sapiens
aaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaawttttcccagtatttttatacgggaaaaattgtattgaaaacacttagtatgcagttgataagaggaattttgtataattatggtgggggattatttttatactgtatgtgccaaagctttactactgtggggagacaactgt

SEQ ID NO: 58772 - DNA, 194 bp, Homo sapiens
ggaggaatgtattgaagaagaatgaagaatgaagaagaagatgactgactgaatgaaataagttgggycctatgccgcaagttttttttttccttgtcatataaagcaatttacccccccctgatacaacaacctcaactcccttttaaaaagaaaaaaaaatttgaaaattgtaaaggccttgttgtaaagat

SEQ ID NO: 58773 - DNA, 475 bp, Homo sapiens
atggccggggaggaggaggaagatgaagaagatgaagatgaagaagaagatgatgatgatgaataagttggttctagcgcagttttttttttcttgtctataaagcatttaacccccctgtacacaactcactccttttaaagaaaaaaaattgaaatgtaaggctgtgtaagatttgtttttaaactgtacagcgtctttttttgtatagttaacacactaccgaatgtgtctttagatagccctgtcctgggggtattttcaatagccactaaccttgcctggtacagtatgggggttgtaaattggcatggaaatttaaagcaggttcttgttggtgcacagcacaaattagttatatatggggaggggagttttttcaccttcagttgtctctgaggcagcttatacgaaataattgttgttctgttaactgaataccactctgtaattgcaaaaaaaaaaaaaaaaaaaa

SEQ ID NO: 58774 - DNA, 272 bp, Homo sapiens
aagcatcaattgtgacacttgcaggacacactacaaacgtgggagcattgtttgtttcttccatatttgggagataaatttatgtgtagacttttttgtaagatacggttaataactaagatttattgagatggtcttgcaatgactcgtattcagatgcttaaagggagcattgctgctacaaatatttctattttgagggagggtttttatggaccactgccccagttgtcagtcagagccgttggtgtttttcattgtttaagatgtca

SEQ ID NO: 58775 - DNA, 218 bp, Homo sapiens
ctctatcagggttttcatttgacagtgtgctcttaccatttccctgtttgagtaagagagtgaatggttctgagtgtttaggaaggatttgcttgcttgcagcagaagttctaggaaaagcaggcacctcccaaatatcttgaggacactcggcagcctctatggtgactaaatccacactttctttaaagagatgcagatgaattactctttctgtt

SEQ ID NO: 58776 - DNA, 267 bp, Homo sapiens
aaagtttgtaaaattcatacttaattaaccaatttaggccagtcatgtctgcttacaggtgttatttgtctgttaaaactagtctgcagatgtttcttgaatgctttgtcaaattaagaaagttaaagtgcaataatgtttgaagacaataagtggtggtgtatcttgtttctaataagataaacttttttgtctttgctttatcttattagggagttgtatgtcagtgtataagcacatactgtgtgggataacaggcttaataaa

SEQ ID NO: 58777 - DNA, 222 bp, Homo sapiens
gtccaaatttgaattctggttctaccccttcatttatcaaatgactttgggcaaagtacttaacctctctgagctttagttcccttctctgtaaaagaataaaatatttcagtcttatcgtgtagatgatatacagagggcacataacaaatgttagatctctcaaatgcttttctggtaacccaattatgccttacacctggattaaaggatggtcctccc

SEQ ID NO: 58778 - DNA, 228 bp, Homo sapiens
gtcacccaaacacttctgctttcacttaagtgtctggcccgcaatactgtaggaacaagcatgatcttgttactgtgatattttaaatatccacaggacttactttttccaaatgatcctagtaattgcctaggaatatctttctcttacctgttatttatcaatttttcccagtatttttatacgggaaagattgtattgagaacacttaggtatgcagttgataag

SEQ ID NO: 58779 - DNA, 272 bp, Homo sapiens
agcaaatgggaattcagtaagctgtttcaaaattttttcatcttaagctgcctcgaatttggtgatacatgtgaatctttatcattgattatattatgggataggattgagacacattggatagtcttaggaggaattaattcttaatttacctgaaaatattcttgaaatttcaggaaatatgttctatgtagaggatcccaacttttaaaaacaataattcaatggataaatctgtctttgaaatataacattatgctgcctgggtgata

SEQ ID NO: 58780 - DNA, 314 bp, Homo sapiens
atggccgggagaacagcaaatggaattcagtaagctgtttcaaattttttcaactaagctgcctcgaatttggtgatacatgtgaatctttatcattgattatattatggaatagattgagacacattggatagtcttagaagaaattaattcttaatttacctgaaaatattcttgaaatttcagaaaatatgttctatgtagagaatcccaacttttaaaaacaataattcaatggataaatctgtctttgaaatataacattatgctgcctggatgatatgcatattaaaacatatttggaaaacggaaaa

SEQ ID NO: 58781 - DNA, 273 bp, Homo sapiens
aaaaggaagaccgagaaaaggagcacaacctcagctctttcaagaagagctagaatcactcctagagaagtaaaaagaactgatatttaatttcagtcttcagactggtcagcattagaaaattcttgcctttattgtactgggtattaaggaccttgctcttcctagtccctttaatgctgtgtgttctgttaagggtctttcatttgtttgtaattttgtttttcagcgaaatttatattgttttgctaggggttcatcccataagaggca

SEQ ID NO: 58782 - DNA, 230 bp, Homo sapiens
cttaaatgggtaaccctaaggcatatcaaagaagcagattgcatgataaacggaaatagaaaaaaagaacctacatttattttgctttagcatccttactctcaccttttatgagattgagagtggacttacaattccctttttacaatttcgtatacttattttttttagccatcattatatgtttaaggctattatgggcaacccatctttgggagctgaaaactgaa

SEQ ID NO: 58783 - DNA, 220 bp, Homo sapiens
taatttgagaatctgttcatagaggatcctaaaatatagcacaatgcagtttatattaatcaaatcaaaagtaacctatcatgaagaaataaagttaaatttagaggtatattagttgcattctacttgattcataggcctaagttaatgggtaagaaatctcttgctcaggaatagaaggcaaaaccacagaaaaaaaaaaaaaaaaaaaaaaaaaaaa

SEQ ID NO: 58784 - DNA, 234 bp, Homo sapiens
atggccgggacagttaatttgagaatctgttcatagaggatcctaaaatatagcacaatgcagtttatattaatcaaatcaaaagtaacctatcatgaagaaataaagttaaatttagaggtatattagttgcattctacttgattcataggcctaagttaatgggtaagaaatctcttgctcaggaatagaaggcaaaaccacagaaaaaaaaaaaaaaaaaaaaaaaaaaaa

SEQ ID NO: 58785 - DNA, 227 bp, Homo sapiens
acacattcataattgactctgtgcaggrtgtcactcaatcagtttgggtttgctttattttattttatatatatattttctgggatcctgtacattgcagtgggtgtgaagatagtattttaatatttgtacaaagtttaatttaattttaattgttctatgtatataactgcatttctaaataattaaaaaaaagttcttatgaaggctaaaaaaaaaaaaaaaaa

SEQ ID NO: 58786 - DNA, 237 bp, Homo sapiens
taacatagctgtgatttttggtatttgaaacactggttttaaatattttgacttgttgagggtatgtttttatatagcaagacattatatagcagtaaaaaatgggtgttttatcttctatataattcccgtttttattattaaccaaacaggtcctaatgaggaggcctctaattgtggaaaaacttcaccttaaaccacatatagggtgtgtgatatcagaggtttattcacaca

SEQ ID NO: 58787 - DNA, 278 bp, Homo sapiens
taaaaaaagaaaaagttggtgattgcattgggaaattcccagggtattactggacctatgtggtgtattgttaaaccagtgtccttgtgatactgttgctcttgatgttcctgatacaggtaaggaaacaagttggtaacctctgataaaaagtatatataaagttaagtattgtcctctgttaattttggttttatttcattggccaaataaaaccaggattccccattgtgtaaataaatggttttgcgtgaattaaggtaaggcttaaatgtcca

SEQ ID NO: 58788 - DNA, 241 bp, Homo sapiens
caggctccgtgctccaaacacacacagaatgggctggtttctttcaagtttaaaaaaaggccccttcttcatgcacaagttcattccctccatgctgtcgtcatcgacatatacaggtgtgtacgtaggtgtatgtgtgtactctgcacgtatatctcttctgtcttgaaggccctgttaactttgtgaaataacttccacatttcaacacaatttacagtacagggaataaagtaatatg

SEQ ID NO: 58789 - DNA, 301 bp, Homo sapiens
tggtgaaataaagaaataaaacacaatacttttacttgaaatgtaaataacttatttatttctttgctaaatttggaattctagtgcacattcaaagttaagctattaaatatagggtgatcatagttcctctaccaagtctggaaagaacatctcctggtatccacaattacaccaggttgctaactgtatttgtacatttccctttgcattcgcttttgttcttgctagaaacccagtgtagcccagggcagatgtcaataaatgcatactctgtatttcgrttctgaaaaaaaaaaaa

SEQ ID NO: 58790 - DNA, 321 bp, Homo sapiens
gatgatagattaaaaaggaaacgagaaagtgaaagaacactttctaggcgtggttctatatctgttaaaatcataagacatgattctagacaggatagtaagaaaagtactaccaaagatagtaaaaaacattcaggctcttattctagtggaaggagcagttctgagtctccaggaagtagcaaagaaaagaaggctaagaagcctaaacatagtcgatcgcgatccgtggagaaatctcaaaggtcttgtaagaaggcaagccgcaaacacaagtctaagttcccgtcaaggtagtatactttttaaagtattttgtct

SEQ ID NO: 58791 - DNA, 157 bp, Homo sapiens
gggaatagttttcaacgtctatttcattccctcgtgcagaggacctctttaatctttgattttggtccctgtttctaagaaaagcaacttaaaagggtcggtattaccgccccttgagaaaaaaggaggcaggcgttaattattcgaggaaattgcc

SEQ ID NO: 58792 - DNA, 110 bp, Homo sapiens
atgtataaaaagattgaataaccagatggaacttactaaagtcattttataatatacaaattggagggaaacaattcttggaataaattgagccatttttacccgaaaaa

SEQ ID NO: 58793 - DNA, 124 bp, Homo sapiens
atggccgggggcatgagatgtataaaaagattgaataaccagatggaactgtgtaaagtcattttataatatacaaattggaggaaacaattcttgaaataaattgagccattgttaccgaaca

SEQ ID NO: 58794 - DNA, 127 bp, Homo sapiens
aatggcattactctacactatagccatttaccccaacttaagtatagaaattacaagtttcagtaatagctgaacctgttcaaaatgttaataaaggtttcgttgcatggggaaaaaaaaaaaaaaa

SEQ ID NO: 58795 - DNA, 302 bp, Homo sapiens
acagaatattttgttgggcagtcctgatttaaaactaagactggcttgtggttaaatgaatatgttcagtttttgaattttaatagtaactccaattcagtaaatggtatcactgtttaccccttttaaagatatgattagacttcgttagtaatgttcaacttttcacaaagatggtgagggccatcttaaaacttactggagattgggtttatatttagagttatataaccgggtatgtgaatatatttaaatacctgggaaagtgtcttcactgtcttagtggccaagcaaggttcacc

SEQ ID NO: 58796 - DNA, 247 bp, Homo sapiens
gataattttgtgaatctgtagattttattttttcagtcttaccttacaaatttcttttctatgaataatagaggaacttacggcactctgccatttgttaatgaaaggaagtgcagaggatttagagaagtacatgatccccagaccacaacaaaccaaaacataaactcatgtctgtgtccatggtcatagttcaaaggttttgtacggctaaaattaaccaataatttaaataaagtgggtttgg

SEQ ID NO: 58797 - DNA, 125 bp, Homo sapiens
aatagtgtttaaacattgaatgtgttttgtgaacaatatcccactttgcaaactttaactacacatgcttggaattaagttttagctgttttcattgctcaataataaagcctgaattctgatca

SEQ ID NO: 58798 - DNA, 296 bp, Homo sapiens
aatgaagtacttaaaattaccgttatacatgaactttgtggactgtaagatttgttatatatgttcaaatgccttttagctggctttttaattaatatgcctgttttgagtcttaatacaatgtaatgtgattgtaaatcatacctattttaaatcattccttcctgtatatttgtactcagagagccttattttattcttccagcagaattactactcgtgatagttcatttacattcccagaatgtgcctctagtgtgaattttgtattcttattaaacgtgtttgctgcagtg

SEQ ID NO: 58799 - DNA, 267 bp, Homo sapiens
aaagttaagaagcaaagaggctaagggaagaacgtcttgcacaatatgaatcaaagaaagccaaaaaacctgcacttgttgccaagtcttccatcttactagatgtgaaaccttgggatgatgagacagatattgcgaaattagaggagttcgttagaaggcattcaaggcagaccggccttaggtcttgggctcatctaaactagttccagttggatacggaattaagagaacttcaaatacactgttgtatgtgttaagagatat

SEQ ID NO: 58800 - DNA, 248 bp, Homo sapiens
tgagttaggtaagcaaagaaccataggtttcttttatttatttaaatcttttatacagatatttgtaaaatctgatgtttatatgtgagagccatttgtgaagatactgtatttaactatttacacaaagatcttttgtgtttttgagttgaactttaaaagtaattaaatgagtttatttgaataggatttctgaagggcttctcgcctataatattgattttggctctgacataaaatgatactct

SEQ ID NO: 58801 - DNA, 300 bp, Homo sapiens
acatcattataatatccagtagctaacattagatctagcttattatttcagaaattaatttaggaaataattattaaaacatgttggctacagtagcactttactgaagtagtattttttggtatctctagcctagaatctcgtgtgttagttttaactgttttgaaaataataagtaacattaacaaaatgttgatatttgggtcataaccgtaacatttgaatttatgcaaaaaaaaggcccggaatgtcatttcaaatgtaatttcctggatgtacccttaaattattttgggtgct

SEQ ID NO: 58802 - DNA, 242 bp, Homo sapiens
aagaatgccaaaatcagcagtctcctggaggagcagttccagcagggcaagcttcttgcgtgcatcgcttcaaggccgggacagtttggccgagcagatggctattttctaaagggcaaagagttggagttctatcttaggaaaatcaaggcccccaaaggcaaataaatccttgttttgtcttcacccatgtaataaaggggtttattgttttgttcccacatttatgttgccaaaaaaaa

SEQ ID NO: 58803 - DNA, 259 bp, Homo sapiens
actaaatgtaaaatttggagtaaatatatatgtcaatatttagtaaagcttttcttttttaatttccagggaaaaaataaaaagagtatgagtcttctgtaattcattgagcagttagctcatttgagataaagtcaaatgccaaacactagctctgtattaatccccatcattactggtaaagcctcatttgaatgtgtgaattcaatacaggctatgtaaaatttcactaatgtcattattttgacaacgtaaattt

SEQ ID NO: 58804 - DNA, 304 bp, Homo sapiens
ggggaatgccacatgaagctggaggcagagattggaggkgatacattgttgggaaccctcagaagataggaaaaaagcatggaatagattctccctcagagttccagtagttgccaaccctgctaacatggttttgcacatctggcatccagaacagttagaatgtatttctgctgttttaaggtacccagttcatggttaatttgttacagcaattctaggaggcttatactctttacagaaaaaaatctttggataatatgcatgtagaagcttcctcaatatacacacaatttgggttcac

SEQ ID NO: 58805 - DNA, 281 bp, Homo sapiens
tgctaaaaaataaataaaagctagatactggaaacctaactgcgatgtggatgttttacccacatgacttattatgcataaagccaaatttccagtttaagtaattgtctacaataaaaaggacattttgcctgccattttcagaattcatcttttggaggtttctgttgatgttaactgagctactagagatattcttatttcactctaatgtgaaattcttgggtgaatatatatgtgcactatttaggaaaggcttcctcttttaatattcacgggaa

SEQ ID NO: 58806 - DNA, 167 bp, Homo sapiens
ggagaatagagtcgaactgaaaattattctgttggccgggcacggtggctcacacctgtaatcccagcactttgggaggccgaggtgggaggatcacgaggtcaggagatcgataccatcctggctaacacggtgaaaccccatctctactaaaatacacgagaaaa

SEQ ID NO: 58807 - DNA, 206 bp, Homo sapiens
tgagaaatcacaactttattgtacacttcattgcaacttgaaattcatggtcttaaagtgagatttgaatttctattgagcgcctttaaaaaggtaataccaaaccataaagttaaaatctatgttatattgaggtcatatctaaagcccacggtattaaccataaattgttatttccctgtttttaattcccgggggaggacctt

SEQ ID NO: 58808 - DNA, 226 bp, Homo sapiens
ggaagaatttgcaagtttggcctttatataagcatgtattgcaggtgctgtttgatttttctaaggtatttttagcccttgatcccctttgcttgcgagaggtggggaactgctcactgacagcttctctgtaacctgcagtaccagttggatcggtcttgaatttgttttcaatagggtcattccttgtcaattagggacttttcccttacaacagtaacaccat

SEQ ID NO: 58809 - DNA, 200 bp, Homo sapiens
aaatttgttttgaaggaacagaagaaatgtgtgttatgcttgtctctaatttgcctaataaaggatattctgtagaagaagtttatgacttagcaaaaccatttggtggtttaaaggatatcttgattttatcatctcataaaaagggtaagagttgattaatagctgttcatatcctctgcaagcatgcatgctttgaa

SEQ ID NO: 58810 - DNA, 230 bp, Homo sapiens
atttgttaaatacgatctctggtggcttagaagaaaataaaagaatgtctgggaagggcaccacacatcgcagttgaacttaatagcaaatagctgttttctaccatgcaggccatgccttagggttccattccataaggttattctggaccatggaccaaattttcctacgagaattagccccagtcctggcgacagaccgagattccatgccaaaaaaaaaaaaaaaa

SEQ ID NO: 58811 - DNA, 240 bp, Homo sapiens
attattatttttgttaaaatacgatctctggtggcttagaagaaaataaaagaatgtctgggaagggcaccacacatcgcagttgaacttaatagcaaatagctgtttctaccatgcaggccatgccttagggttccattccataagttatctggaacatggaacaaattttcctacgagaaatagccccagtcctggcgacagagcgagactccatgccaaaaaaaaaaaaaaaaaaaa

SEQ ID NO: 58812 - DNA, 290 bp, Homo sapiens
aagcatgatcttgttactgtgatattttaaatatccacagtactcactttttccaaatgatcctagtaattgcctagaaatatctttctcttacctgttatttatcaatttttcccagtatttttatacggagaaaattgtattgaaaacacttagtatgcagttgataagaggatttggtataattaagtggggtgatatttttcataccgtatgtgccaaagcgcttacctactgtgggagacaactctttttaataacaggggtacacttcccagaaaaaaaaaaaa

SEQ ID NO: 58813 - DNA, 191 bp, Homo sapiens
aaggtgggcgagaatcgcaaaattagtcgccttcgtccagagtgcccttctgatgaatgtggtgcttgggtgtttatggcaagtgactttgacagacattattgtggcaaatgttgtctgacttactgtttcaacaaaccagaagacaagtaactgtatgagttaataatagacatgaactaaaaaaaaaa

SEQ ID NO: 58814 - DNA, 140 bp, Homo sapiens
atagaattatataggactaaattttctatattctcctagaattaagttattggactttgatgagtcaagaggtatattgtaagcttcaggccaaccactaaggaaataactcaaggagtagagttaaagatattctaact

SEQ ID NO: 58815 - DNA, 221 bp, Homo sapiens
ggcaggggggatggaaaataagtagaaacaaaaaagcagtggctaagatggtatagggactgtcataccagtcaagaataaaaggggtgaaggataaaaggggatattgatgacaaggttgatccacttcaagaattgcttgctttcagggaggagagatgtgtttcaacaagccaactaaaatatattgctgcaaatgggaaaccaaaaaaaaaaaaaag

SEQ ID NO: 58816 - DNA, 115 bp, Homo sapiens
acatcatagtttactcttagtcctctgatggaagggagatccaagtagtgtttagccgcgctattcatgcctatatgatccatatttctacgaataattgcatggagcaccttgg

SEQ ID NO: 58817 - DNA, 440 bp, Homo sapiens
gacatcagtctccaacatgtttctgttttgttgtttgattcagcaaaaatctcccagtgacaacatcgcaatagttttttacttctcttaggtggctctgggaatgggagaggggtaggatgtacaggggtagtttgttttagaaccagccgtattttacatgaagctgtataattaattgtcattatttttgttagcaaagattaaatgtgtcattggaagccatccctttttttttacatttcatacaacagaaaccagaaaagcaatactgtttccattttaaggatatgattaatattattaatataataatgatgatgatgatgatgaaaactaaggatttttcaagagatctttctttccaaaacatttctggacagtacctgattgtatttttttttttaaataaaagcacaagtacttttgagtttgttaaa

SEQ ID NO: 58818 - DNA, 182 bp, Homo sapiens
tctttcagcaacccggtccagtacttggagatacagccatccaccttcagatgtgtctacgtggcgctctggccattcaactcggaaactataaagtgaattctcaagagaaggccctcattttttattaacctcggcaggaattcttggtgtaatggtcattggctaaaaagagtagaata

SEQ ID NO: 58819 - DNA, 187 bp, Homo sapiens
gaatctttcagtatagtactaataattaaattttcagtcatttccaaagacaagtattttgttccattttgagattctgcactcatgacaagttcattgacgttggggccaaaagctgttgattttctcaagttgacggttgtcaatatatcgaactgttcccaagttagtcaagaatgtctcaaca

SEQ ID NO: 58820 - DNA, 100 bp, Homo sapiens
tgcaaaaccttttactggttgcatggaaatcagccaagttttattaatccttaaatcttaatgttctccaaagcttggattaaatacaatatgggatgtt

SEQ ID NO: 58821 - DNA, 218 bp, Homo sapiens
caaggtcaggatttcaagaccagcctggccaacatagtgaaatcctgtctctactaaaaatacaaaaaaattagctgggcgtggtggtggggacctgtaatcccagctactcgggaggctgaggcaggagaatcacttcaacccgggaggtggaggttgcagttaaccaagatcgcaccattgcacttcagccttggcgacagtttaagagtcagtct

SEQ ID NO: 58822 - DNA, 165 bp, Homo sapiens
tgtgatattttaaatatccacagtactcactttttccaatgatcctagtaattgcctagaaatatctttctcttacctgttatttatcaattttcccagtattttatacggaaaaaattgtattgaaacacttaggtatgcagttgataagggggatttgggata

SEQ ID NO: 58823 - DNA, 280 bp, Homo sapiens
aaagaattagtaaacataataattacataaaattaaaagaacattaaagcagtatatgttcaagaggacagaaggaagcccaggcagactgagaagggacaaagaaatatgaaaaagagatcccaattagacttctagagatgaaaagtacaatatctaaggtgaaaaatggatggaataaagagcagattagacattaggcaaaagaaaagaattagcaaacttaaagatgtagcaatggaaactgtgcaaataaaacagagaacaaaaagatttcttt

SEQ ID NO: 58824 - DNA, 167 bp, Homo sapiens
ggggaggaagatagatttggaataggaataaggtttagtttttaggaaacgaaattctaaagatttagaaaaaaagtttacaacataatttagtttaagaaaaattttgttgatagaataatttttaacggtattttgacataacattaaagcttgttttttttttt

SEQ ID NO: 58825 - DNA, 236 bp, Homo sapiens
atggccgggggagcgcaagatagatttggaataggaataagctctagttcttagcaaccgacactcctacaagatttagaaaaaaagtttacaacataatctagtttacagaaaaatcttgtgctagaatactttttaaaaggtattttgaataccattaaaactgcttttttttttccagcaagtatccaaccaacttggttctgcttcaataaatctttggaaaaaaaaaaaaa

SEQ ID NO: 58826 - DNA, 174 bp, Homo sapiens
ataataatataaaaattaaaaaataaaaaaggaacaacaaaaaaacaaaaattaggagtaataatgagattgtgtgttaaataggtgttaagcaatggtaattaatgattttggtgtgaagggaatttgcaaaattaggacgagttaataaatggttaaaaaattaggattaaa

SEQ ID NO: 58827 - DNA, 230 bp, Homo sapiens
atggccggggatcaataaatactaaaaaatttaaaaaaactacaaaaaagcaaacaaacaaacaaacaaaaaaattcagcgagttaattaatgagaattgtcctgctcacaataggtgctcaagaaatggttactaccatgattctggttgtgaagtgaaattgccaacacctgagacagagctcattaaatgtttaccaaactgaagaataaaaaaaaaaaaaaaaaaa

SEQ ID NO: 58828 - DNA, 320 bp, Homo sapiens
ggggattctaagatttggtttgggatcaataggaaagcatatgcagccaaccaagatgcaaatgttttgacatgatatgacccaaattttcagtagggaagtcaacccaaaccacttcctgcctttcaacttaaggtgtcctggcccggcaattactgtggggaccaggcaatgatcctggttactctgtgatatattttaaatatatcacagagtctctactcttttttcacaatgtgtatcccgggtaatgtgctctgagatatctcttctctctaccccgtgtatatgatctacaactttctcccatgatgatttta

SEQ ID NO: 58829 - DNA, 230 bp, Homo sapiens
ggatgcagaaaacatgaaaatatgtcccatccacaggaagaaaaatctgtagcccctgagagggctcaggtattagaccagcaaggctttaaatcagctgccaataaatatgctcaaaggaccttaaaggaaattgttatttaaaaaaggaccagggggagttttggcaaatattatcctacccagtaggagatattccttatgagagattttttataaaaaaaaaaaaa

SEQ ID NO: 58830 - DNA, 230 bp, Homo sapiens
atggccgggatgcaagaaaacatgaaaatatgtcccatccacaggaagaaaaatctgtagcccctgagagggctcaggtattagaccagcaaaggctttaaatcagctgcaataaatatgctcaaagaactgaaagaaattgtatttaaaaaagtacaggggagtgtggcaaatatatcttaccagatagagaatatccataatgagatttttttaaaaaaaaaaaaaga

SEQ ID NO: 58831 - DNA, 309 bp, Homo sapiens
aagttaaagtaagtatactgtggagaggacttccaaatgtagttacctcagctatatcactgcccaacatcagaaaacctgacggctatgattactatgcctttactaaagatcaatactataacaatgatgtgcctaggtaggaccagcagggccattactacttggtcctggccggacctattccaaggtctggaccactggtccttggctctgttgagacaggaggggtgtcatctgagtaagggatttgtatatttaaatatagacactctaaaacccatttttttattagagtatattgcacat

SEQ ID NO: 58832 - DNA, 270 bp, Homo sapiens
ggaagaccaagaaggatgattctcactcagcagaggatagtgaagatgaaaaagaagatcataaaaatgtgcgccaacaacggcaggcggcatctaaagcagcttctaaacagagagagatgctcatggaagatgttggcagttaggaaggaccagaagaggaggatgaggcaacaattcaagagaaagaattccgcaaccattaaggatttcctattggaggatatatacgctagagtactctatggcagttacaaaaaaaaaaaaaaa

SEQ ID NO: 58833 - DNA, 312 bp, Homo sapiens
ttaaggatacttttggtaagagaatagtttttatcagagcaggctgcaggtagaatatttctcaattactatttacagctgagtaacttttttcctatggacataaaaatatacactctgcaaatgattttttaatggaaaatgacagcctattttctgcaacttgggttttttacattattaatcaatgggcatatccacttaggttgcatattgaggtctctccgtgtttggtggacaacctgagattctgtgtttgtgtggtgtgtccctaattgagcccagtgctctctctatacactgtaatagggg

SEQ ID NO: 58834 - DNA, 306 bp, Homo sapiens
ggatggatgaatttagacagataattcaaaggtacatgttaaaagaactggatacttttttgtcactggaacgaacttgatcagttcatcaataagtttttcctaaacgggtgtctttatacatgatcagcagctcttcactgactttgttaatgatggtaaaggttatcctagacacatgaagggatatacaggtggtaatgatggagtaattgagagaggttgatgtatatatatatagaccactctctgtggcacacactttctccccccccatatggcccaggccgttacacataaaccctg

SEQ ID NO: 58835 - DNA, 312 bp, Homo sapiens
caagcagactctgaagatgatcagacaaggcaaagcgaaattggtcattctcgctaacaactgcccagctttgaggaaatctgaaatagagtactatgctatgttggctaaaacttgtgtccatcactacagttgcaatcatattgaacttgggcaccgcatgccggaaatactacagagtgtgcacacttgctatcattgatcccggtgactctctacatacattagagagcatagccacagacagactctgtgtagaaagtgtaaccctttcacatctcacaatattcacctctcacaactctaaactgt

SEQ ID NO: 58836 - DNA, 290 bp, Homo sapiens
ggattaatacatatggatgttactctcttgcaccaaattatcttgatacattcaaatttgtctggttaaaaaataggtggtagatattgaggccaagaatattgcaaaatacatgaagcttcatgcacttaaaggagtatttttaggataaggatttgcatacttacctagtgagacttttctagaattatttttcactctaagtcatgtatgtttctctctgattatatgcatgttatgtttaataagctactcgcgcaataaaacatagcacatggcacaaaaaaaaa

SEQ ID NO: 58837 - DNA, 153 bp, Homo sapiens
attgaaataagtcaaggatatacttctattcaccatagtactgaaagtcctagacagagcagttaaggaagaaaaagaaataaaagccatcaaattgggatacgaaaaaaaaaaaaaaaaaaaaaaaaaaaaaaaatttgggcccccttggcc

SEQ ID NO: 58838 - DNA, 140 bp, Homo sapiens
atggccggggtctaccattgaaataagtcaaggatatacttctattcaccatagtactgaaagtcctagacagagcagttaaggaagaaaaagaaataaaagccatcaaattgggtacgaaaaaaaaaaaaaaaaaaaaa

SEQ ID NO: 58839 - DNA, 216 bp, Homo sapiens
ggacttatttgaaattttcactttagtcaaattattttttgtattagtttttgatgcagacataaaaatagcaatcattttaaattgtcaaaatttccagattactggtaaaaattatttgaaaccaaaccttatgggtattaagggctagtcagacccctataccataaggtgtagttaaccataccagattattatgtagcacaaatgtatgct

SEQ ID NO: 58840 - DNA, 217 bp, Homo sapiens
gtgtgtgattcagtctgattcacagaattctgagagtaatatggaataaaacaactccacttagatgataactgaagcatttcctgccttgtgaaaatttggattttaaattgctgttagaatgggaaatttggacactttatatcattgtataatttcagagatttagtttctgtatctcttggaaaccatgatatatagcacaacacgtgagaga

SEQ ID NO: 58841 - DNA, 252 bp, Homo sapiens
taatgataatgaaaagcccttaaaacagcaggacaaaaaaagagaaaaggaaaaggaaaagcagaaaaaattagaaaagagaaaattatagaattgaattgaaaaaaatcaaataattggcactttgattggcatgaatcaactaaaatagataactcttcagctagtctactttagagaggtagagaaacccaggccaaaatccgcaatgaaaacaggggacatacacagcagagatatttgggagttagg

SEQ ID NO: 58842 - DNA, 236 bp, Homo sapiens
gcatgatcattcaatggatcacagtgaagcaaaggacacaactttttattgtaccccttaattgtcaacaggagttaactgatttgttgtggtgctcagactttttatacaggtgctagtgttttatcctatgtattttaactcattagtgcataaaggcaagccccatataatgaagtctcagggtatatgaaagtagctggcttcacaataaaatttttgagtacacacacaca

SEQ ID NO: 58843 - DNA, 280 bp, Homo sapiens
tgatgataaaaaaagtagtgtgaagtccggtagtcgagaaaagcagagtgaagacacaaacactgaatcgaaggaaagtgatactaagaatgaggtcaatgggaccagtgaggacattaaatctgagggtgacactcagtccaattaaacctgatctgataagacctcagatcagacagaggcctactgttcgagagatttttggatgattactgagaccggcataaagtgaagatcgacatttaaaaaatgaggtgaaagacagctatagtggcataga

SEQ ID NO: 58844 - DNA, 280 bp, Homo sapiens
aatttttatagctccacatatgactgagaacatgattcatcttgatgatatttgtctttctgtgcctggcttatatcacttaatatcctccaattctatgatgttgctgcaattgacaggattttattcattattcagccattgtcatggctgaataatatttcatcgtgtatatatagcacattctctttatccatctgtgtgatggactctcggggttaattctgtatctcggctatagtgaatagtgctgcaataaatatgaacatgcagacacaaa

SEQ ID NO: 58845 - DNA, 345 bp, Homo sapiens
taaaaaataattttccaagtgcagctcggtattagaggtgactaaatatcacattataattgagatgagaactatatcattgtattgctgaattggtgatgtcaggccattctatttcacagccccaagggaccatataaaaggcatttgcaagcaagatgtaagtacagcatcagcatatattgtagccaaatagatctacagagagagtttgtgtttgggacccaaaggtccagctgtttcttaaaggattatcaggatttatatgggaggcacagatggacccaatactattgtctagagtattctaggggagaggctaatatgtagagagggtgatcagtg

SEQ ID NO: 58846 - DNA, 375 bp, Homo sapiens
atggccgggatgtctaaaaaataattttccaagtgcagctcggtattagaggtgactaaatatcacattataattgagatgagaactatatcattgtattgctgaattggtgatgtcaggccattctatttcacagccccaagggaccatataaaaggcatttgcaagcaagatgtaagtacagcatcagcataattgtagccaaatagatctacagaaagagtttgtgtttgggacccaaaggtccagctgtttcttaaaggattatcaggatttaatgggaagcacagatggaaccaatactattgtctagagtattctaggggagaggctaatatgtgaaaggtgatcagtggcaggctgattgaaacacca

SEQ ID NO: 58847 - DNA, 228 bp, Homo sapiens
gcttcaaaatatggattaaaacatttagcagaagagaaacctgatggccttatcaatgaagctactaggcaagttgctttggcagatgccattctcattaataaaacagacttggttccagaagaagatgtaaagaaactaagagcgacaattagatccataaatggactaggacacattcttagaaacacacagatcaagagttgatctctctaatgtattagatct

SEQ ID NO: 58848 - DNA, 155 bp, Homo sapiens
gaggggtgacacagtgttccctcctggcagcaattaagggtcttcatgttcttattttaggagaggccaaattgttttttgtcattggcgtgcacacgtgtgtgtgtgtgtgtgtgtgtgtgtaagggtgtcttataatcttttcacctatttct

SEQ ID NO: 58849 - DNA, 324 bp, Homo sapiens
aatagattgtcaatacaaatatctcaaaaatcagttcaacacagatccaagtggaccatttacatttgccattttccgattccattcttgggtcttttgacaagacgattgttacttacttaaaaggagcacttagtttgtcgaatttcagggggtgttaaaactttttcaccaaggtacaaaaaattcccaaatttcacttttatttattttcgcttcagggatccaagtgacacggttatatattcatcgcgcgcgtatagatctgacagaatctaatgttgtctctttagtgtgagtgatccacctgcctcagcctcccac

SEQ ID NO: 58850 - DNA, 461 bp, Homo sapiens
atggccggggtgatcaatagattgtaatacacatatctaaaaatagttaacacagatcaagtgaacattacattgccatttttaattcattctggtctttgaaagaaatgtactactaaagagcactagttgtgaatttagggtgttaaactttttaccaagtacaaaaatcccaaattcactttattattttgcttcaggatccaagtgacaaagttatatatttataaaattgctataaatcgacaaaatctaatgttgtctttttaatgttagtgatccacctgcctcagcctcccaaagtgctgggattacaggcttgaaagtctaacttttttttacttatatatttgatacatataattcttttggctttgaaacttgcaactttgagaacaaaacagtcctttaaattttgcactgctcaattctgtttttcgtttgcattgtctttaataaaa

SEQ ID NO: 58851 - DNA, 282 bp, Homo sapiens
ttaataaaatagtgaggcatgttgtataaagtgtgttttatgtctcaattgaaatgttatagagataaatttaaaatagatcatgatgggttttgaatctgattctaattttcacatgttatgagcttttgttgctttcctatttcatacacatttctttatggggttcacttagactgcatgaaattgcagatgccaattaccttttaacagaattaaattcacatatatgtatactcgacatgtatatatccatggcatttgttattctacacggtatat

SEQ ID NO: 58852 - DNA, 258 bp, Homo sapiens
tgatattttaaatatccacagtactcactttttccaaatgatcctagtaattgcctagaaatatctttctcttacctgttatttatcaatttttccagtatttttatacggaaaaaattgtattgacaacacttagtatgcagttgataagaggaatttggtataattatggtgggtgattatttttcatactgtatgtgccacagctttactactgtggacagacaactgttttaataaaagatttacattccaaaa

SEQ ID NO: 58853 - DNA, 260 bp, Homo sapiens
agagataaactgttcaagtcttagcaatgatactgcacttctctttgacaggttctgggcttaagttagaggccctactggttccaaaccatattccactgacttcgcaagtaaaataaatttgattctgaaataggaaacaaaaaaggagacataaccgaatagtagaagacaactgtttgtaggaagacgatgcagatggaatgatgtggacattgagtaaccatgtcaataaaatatataaaccacaaaaaaaaaaa

SEQ ID NO: 58854 - DNA, 285 bp, Homo sapiens
accaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcactttttcccagtatttttatacggaaaaaattgtattgagcacactgtggtatgcagttgataagaggaat

SEQ ID NO: 58855 - DNA, 287 bp, Homo sapiens
gtaaatgtaaaattgaaagtcacatatcacagaaaaggaatggggaatgatagaacagttgataaaggctaggaatttcaaaatctttcactttgtgattgcccagtacactcataattatctaaattatctagaaggaggtagggaaatttattaggagcactacacaatgggaagagtcatcatttaccaaaaaaaaaaatggggttgtaaagggggagagtcccagtttgtaaccagtttcaggcaacagccccaggggggttagagttctccagggtttgggc

SEQ ID NO: 58856 - DNA, 285 bp, Homo sapiens
ggaatgggaagttaaaaaaggaagcaaaagaagtttttccaaagatgttatgaagggctctaatccaaaagtaccacagcaaaacaacttcagtggactgtggtgtatatgtattgcagtatgtagagagctttttttgagaatccaattctcagttttgacctacctatgaatttggcaaactggtttcctccaccaagagtgagaacacagagagaggaaatccgaaacataattctgaggctacaggaagatcagagcacagagaaaggaaagcataaggac

SEQ ID NO: 58857 - DNA, 281 bp, Homo sapiens
caagtgtggaaggtcttaatgtaccaacaaaggctactttagaggtatcctctatcataaaaaggaaaccaaatcaagctaaaaagggccttggggcaaaaaaaggaagtttgggagctcagaaactggcaaacacatgctttaatgaaattgaaaaacaagctcaagctgcggataaaatgaaggagcaggaagacctggccaaggtggtatctaaagaaggatcaattgtttcatcattacgattagcctataaggatcttgaaattcaaaaaaaaaaa

SEQ ID NO: 58858 - DNA, 284 bp, Homo sapiens
aggctttcaaaagggccaggtagctggtggtgtttgtattaacatctcataggctctggatcattcacagccacgtattgatctatgtggttttgacgtttaaattttaatgaagcagccttagtggggaagaaaacagctatgcatgtgcctcgtaaggggggaagaggacctcgttcattcctcgtttctaagccagcatcttaagagtaggtattacctcgtgtgtgaaatcaaagtattttaaaattaactctaggaggaatgttggatttccctgtgtt

SEQ ID NO: 58859 - DNA, 286 bp, Homo sapiens
aaagtgtaggtgattaaataatttgaaggcgatctctaaaagagattaaccgagtgattaaaagaccttgaaatccatgacgcagggaggattgcgtcatttaaagcctagttaacgcatttactaaacgcagacgaaaatggaaagattaattgggagtggtaggatgacacattttgagaagatagaagtttgaagttgaaaacttgaagacagaagtacgggaaggcgaagacaagcatagagaagatagggaaattaggaagataacacatacttttaggag

SEQ ID NO: 58860 - DNA, 221 bp, Homo sapiens
tgaatgcccaggatgctataaaatcaccacggtctttagccatgcacaaacggtagttttgtgtgttgcgctgctccactgttctctgccagcctacaggaggaaaagcaaggcttacagaaggatgtttccctcaggagggaggcagcactaaaagcactctgagtcaagatgagttggaaaccatctcaataaacacacttttggataaaaaaaaaaaa

SEQ ID NO: 58861 - DNA, 258 bp, Homo sapiens
gaaataattaggtattttctccaaatgttcactagtactctgccactttatttctctcatctgttacacaaagaaccaccaggaaagcaaatcagtttggttggtaactctgtaattcctaactatcactggtttggttctggactaaaactacattgacagattgaatttgcctaatatgatgactgtttttaatatggatctgtatgtgttctattcagcacaaggaataaaattttagttgagggttcagcactt

SEQ ID NO: 58862 - DNA, 196 bp, Homo sapiens
gtaggtcagttctcaagattgtgctatcataaatgaatgaattcaaaacaccttgtaatttcatatggaattataaaaattagggtttcttgggttttggccttataagagtgctagtatgtatttggtagaatacatcttactatttcacaattttaaaaatcagtacactctttcaagggttttcttttaattt

SEQ ID NO: 58863 - DNA, 125 bp, Homo sapiens
actagtatgcagtgataagagattcgataatatcgtgggtgattatttttatactgtatgtgccaaagctttactactgttggaagacaactgttttaataaaagatttacattccacaaaaaaa

SEQ ID NO: 58864 - DNA, 161 bp, Homo sapiens
gagttgtagacactgatctgctagtgctttaatattgtaaatactggtcttaggaactcttgttagggaaaaaattgaaaggaacttaagttctcgaatgtaattgtggaatcttcaacccaagaagtggagttgtaaccccttatagcctaagcggctgk

SEQ ID NO: 58865 - DNA, 184 bp, Homo sapiens
gaacatagacactgggacactagaggaggaaggagaagagacaaggctgaaagctacctattgggtactgttctatctatcttagtagtagtagcaggtattcccaaaccttagcaatacggtaatatacccagttaacaaaccaatgacaagttggcccttgaacccatatgggaaagttgaa

SEQ ID NO: 58866 - DNA, 501 bp, Homo sapiens
atggccggggatataaaaatgaaaacaatagacactggggaccactagaggaggaaaggaagaaagagacaaggcctgaaaagctacctatggggtactgtgctatctatctgagtagtagtagcagttatcccaaaccttagcaatacgtaatatacccatgtaacaaacctagacatgtggcctctgaacctataggaaaagttgaaattaaacaaaaataccaaaatatgtgctctttataaatgtgcagtcacagttaaaatgcatggctatctagaataattattgtttggtagtacactatgttgattcaatattttttggttaattttttttgttaaattttgtttcaccattttatattttagtggcttatgttttacagtaggctatgtcacattaattaattgtgtttttagtttttatgtatcaaattttatatgacaataattcaactctgtcacattaaaacaatgtttggacaaaagtcgaaaaaaa

SEQ ID NO: 58867 - DNA, 239 bp, Homo sapiens
gtttctaaaacacacacaagcacattgggccaactatttagtaagcccggatagacttattgccaaaaacaaaaaatagctttcaaaagaaatttaagttctatgagaaattccttagtcatggtgttgcgtaaatcatattttagctgcacggcattaccccacacagggtggcagaacttgaagggttactgacgtgtaaatgctggtatttgatttcctgtgtgttttgccctggc

SEQ ID NO: 58868 - DNA, 244 bp, Homo sapiens
gaaaatgtgggttctgcgtgtggcactgatttatcaagacaagagggacatgcttccccttgtccacctttgcagcctgtttctgtcatgtagtttcaacaagtgctacctttgagtgtaaactaaggtagactactttgggaatgagaacatgcaaaatcaggaaaggctgtagaaggaaatataccttaacaggctgatttggagttagccagaaaaaaaaaataaaactctcattatttgt

SEQ ID NO: 58869 - DNA, 245 bp, Homo sapiens
aatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtcttgcccgcaatactgtagggacaagcatgatcttgttactgtgatattttaaatatccacagtactcactttttccaaatgatcctagtaattgcctagaaatatc

SEQ ID NO: 58870 - DNA, 248 bp, Homo sapiens
aaaatgaagtaaaataagataaagtttgggataaataggaaagcatatgcagccaaccatgatgcaaatgatatgaaataatattgacaacattttaagtagggaagtcacccaaacacttatgactttcactataggtatctagccccaataatgtatggaccagctgatacttgttactatgatatttatacatatcccacagtactcaatactttcaactagtcctagtaactgcctagagaata

SEQ ID NO: 58871 - DNA, 175 bp, Homo sapiens
aaaaaaggtctttaacccaaatcaccaaaattatacacactgaacatatttgaatgtgtaatgatacaatcaagatacttggattttttaaaaaaataagggttaatcaggctttattctcagggaaaaataaagctgccgttttgtgttaggaaaagcaaaacacaaaaaaaaa

SEQ ID NO: 58872 - DNA, 205 bp, Homo sapiens
tggccgggaaccaaaaaaaaggtctttaaccccaaatcaccaaaaattatacaacactgaacatatttgaatgtgtaaatgatacaatcaagatactggattttttaaaaaaataagagtaaataagactttattctcaggaaaaaataaagctgctgttttgtgttagaaaaagcaaaaaaaaaaaaaaaaaaaaccaaaaaaa

SEQ ID NO: 58873 - DNA, 236 bp, Homo sapiens
aagtcacccaaacacttctgctttcacttaagtgtctggcccgcaatactgtaggaacaaggcatgatcttgttacctgcgatattttaaatattccacaggtcttcactctttccaaatgatcctaggtaattggcctaggaatatcttctctcttaccctgttaatttatactaattttttcccagagattttttacacgcgggaaaaaatagtgattgtgaaacactcagagt

SEQ ID NO: 58874 - DNA, 256 bp, Homo sapiens
taaattagttagattttgcaagtctacaaatgagtcttgcaacagaactcacagccttttgactttttttcccctaacctttaggcaatggtaggtatcctgaggccattaattttttggggtttttttaaaattcccgcaggtatatagagaaccctttcaccgcattttcacatctgattggtctctcacgtagtctcttctctcatatcccatattatcccacacatatattgttgacacgggacgtaaacgc

SEQ ID NO: 58875 - DNA, 355 bp, Homo sapiens
atggccgggcataatataaaattagttagattttgcaagtctacaaatgagctcttgcaacagaactcacagcctttttacttttttcccctaactttagcaatgtagtatcttgagccattaatttttgggtttttttaaaatccagaaggtatatagaaaccttttcagatttttcatctgatttgttcttgcagatgttcttctatcaaataccttattttaccttacagatatttgttgcacaggcagatactgctgtatttagacatttctatttcagttcattaaaaactgcaaaaccaatctgtatcatgtaccaaactgacttaaaataaatctacatgtttattca

SEQ ID NO: 58876 - DNA, 241 bp, Homo sapiens
ctgaaactgaatttaaagaatgctatcttggaaaatcccatacgtctgtgcaattttttattctgcctagtgctattctgcttgtttaacctagattgtacaaaataacttcaattgcttaattctcaaataccaaggttaggacttgaaggaaatgggccttttaggaggcacacattttaatatatatttgttcttacatatatatagtgttacacattgtgtgtgttgtgtgcactat

SEQ ID NO: 58877 - DNA, 246 bp, Homo sapiens
aaagaagacaaactttgcatctcagtatgaattattaaatttatttgaatgatttttctttacaaaacaactcattcattagtcatgtttatctgcttaggagtttagggaccaatttggcaattttgtggttttccgagattaccgtttccttaaaggtccagtatttataaatagcgttctgtaaatttacacacgctttttgtgaggaagcgcggtttgtataataaatatggccttggagtc

SEQ ID NO: 58878 - DNA, 246 bp, Homo sapiens
aaacaagaattttctttgctctgtctagcttaaactactactcaagctgcttaagttcttaagtattgtttgtaatcaccaataaataagtgcatttgcaattcatcagtcattattagcttttattaaaagaaggttaccggtttacaatgtaactataatctcttgaatttgtgtatcttattaatgaggtttaaaggtgtaaaacctaacccttcttaaagctccattgtcttatgtttttag

SEQ ID NO: 58879 - DNA, 165 bp, Homo sapiens
aagaaggaggaaaaaacccaacatttttggaccaaaaggtaaaggattatctttcaggagagaaattttcttaagttggtctttttacaggggtttttaccaagcatggtatttggaggtaacagttttttctctaggtccataaaaatcttttttaatgtatct

SEQ ID NO: 58880 - DNA, 200 bp, Homo sapiens
atggccgggatctgaagaaggaggaaaaaacccaacatttcttggaccaaaagtatagtgactatctgttcatgagagaaattttctgtaagcttgctgttttacaggggatttatcaataattgattttgaggaatcagtttttttctatggctaataaactttttaattcacttaaaaaaaaaaaaaaaaaaaaaaaa

SEQ ID NO: 58881 - DNA, 136 bp, Homo sapiens
gatgaaagtatagtttaagaaaagttaatctactgttgtgttatatatagagacctcagagacaccatctaagaggccgatagagttttccaacaaaaaaaaaaaaaaaaaaaaaaaaaaaaaaaaaaaaaaaaaa

SEQ ID NO: 58882 - DNA, 130 bp, Homo sapiens
atggccggggacatgatgaaagtatagtttaagaaaagttaatctactgttgtgttatatatagagacctcagagacaccatctaagaggccgatagagttttccaacacaaaaaaaaaaaaaaaaaaaa

SEQ ID NO: 58883 - DNA, 219 bp, Homo sapiens
aaactgatttgggatttggggtggaaatattttgaatattaatttatttttaaagatgcaagataggactttgtgcaatgtatttttgtaaatgcttttcaaaatatctgtctttggtagtgcttctgctgctgccacccaattgataagatgctattaagaggtttaaataaagaggtttaatttttaaaaaaaaaaaaaaaaaaaaaaaaaaaaaaa

SEQ ID NO: 58884 - DNA, 310 bp, Homo sapiens
tccctacctagaatgtcagatgtttttcagttatctccccatttgtcaaagttgacctcaagataacatttttcattaaagcatcttagatcttaggacacaattattattctaacaatgattattagctcaatcacttattttgataactaatgatcacagctattatactactttctcggtaatttgtgtgcatgcctcatttccctgacttaaacctcactgagagcgcaaaatgcagctttatactttttgactcttcaattgcctagcacaatagtgagtacatttgaattgaatatataataaa

SEQ ID NO: 58885 - DNA, 205 bp, Homo sapiens
aaagggatgatgacaaggttgatccacttcaagaattgctttgctttcaggaaagagagatgtgtttcaacaaggcaactaaaatatattggtgcaaatgggagcttttctgttctattataaaaccgtcgatgtattctgacccaggtggcgacaatctttctaaaggagatacactctaaagtgtataggagagagagaaaaa

SEQ ID NO: 58886 - DNA, 98 bp, Homo sapiens
agcttgatcatagttcatacatataaatgggggtgaaataaaggaataaaacacaatacttttacttggaaaaaaaaaaaaaaaaaaaaaaaaaaaaa

SEQ ID NO: 58887 - DNA, 234 bp, Homo sapiens
ttcaatctgtactgaattatctttcatctagcaattgtgcaattccaaatgcaggtgaggttgagggaaagcgggcattccctcacattcattggatctatggtgttggttgtatcaagagtctcaaaaatgctcatattcttccgtcctagaattgtggtctagcctaaaggaataattcagagactctcatgttttttttaaagccttttatgtcacacaacatgtatcata

SEQ ID NO: 58888 - DNA, 405 bp, Homo sapiens
tctaagatttggtttgggatcaataggaaagcatatgcagccaaccaagatgcaaatgttttgaaatgatatgaccaaaattttaagtaggaaagtcacccaaacacttctgctttcacttaagggtcttgcccgcaatactgtaggaacaagcatgatcttgttactgtgatattttaaatatccacagaactaactttttccaaatgatcctaggaattgcctagaaatatctttctcttacctgttatttatcaatttttcccagtatttttaatacgggaaaaattgtatttgaaaacacttagtatgcagttgataagaggggttttgtataattattgggggggtattattttttatactgtatgtgccaaagctttactactttggagagacaactgt

SEQ ID NO: 58889 - DNA, 241 bp, Homo sapiens
aaattgtaggccattttcttataacatttcagttacttttcagttaattattcctttaaaaagaaaatacagcagaacctcactgtagcattctttactgcagagcaaaattcaatttaagatgggcttctctgaggtccacatcatggcagttcatttactcttgtgccaaattgcaacaccacgtcttaagcagtttcacagcattgtcccctacaatgttattccaaggctcttatgt

SEQ ID NO: 58890 - DNA, 204 bp, Homo sapiens
ttctagtggaaattggagggaatttgttttgcataatttgtctaggatctatgcaaatatagctccactaaaggaccatagggaagagccagccttgccttttcttatatgattttgttaacaaaatttactgggacttttaaatctagctatagagttgggaaaaactatttccacttagaaatttaactggttttgttaaaa

SEQ ID NO: 58891 - DNA, 197 bp, Homo sapiens
ttaaatgaatatttttgtaaaagtaaaagcaacaaattgataaattgattatttgaaactttacaacacaattgcatcccaaatacaaattgtattgcttattcattatagctattcgtcctgtaatctgtttctaggtggaggcatactccagtgttttaggggtttggaaaataaatatttaaatttcacagaca

SEQ ID NO: 58892 - DNA, 239 bp, Homo sapiens
accagtttcttttagatggacagttactctgtgataacttcatagctgcctgtacagaaaagaaaatccccgttgtttttcgattgcaagagggttatgatcatagctactacttcattgcaacctttattactgaccacatcagacatcatgctaaatacctcgaatgcatgaaaaactccaaataagagaatctctccaggcttctaaaggccggtaacatgcaactccattgctgw

SEQ ID NO: 58893 - DNA, 208 bp, Homo sapiens
taataaggtgattacaaataatggttaacaatagggatcggggcaaacccctgctgtggcccttagagctaagtgaactttggcagagaatgtcaacattctgtcttggattatatgccattaaagtgacaacggtatgtatctcaaaaagctgccatgggggttaataatatatacagatacagtgtcataaggtttcttggtgagt

SEQ ID NO: 58894 - DNA, 220 bp, Homo sapiens
cactatttgagaaaccctcaaatttggctttcattatataatgatacatttagacaaaaccccaaactaagccatttgaaacaagattctctccattgcagtttgtagcaatgttatttctatgtatgtcatgagaaggctaaatatcagtgttaatttcttgtttgaatccgtgaaatcatgcctgtaaagccccaaacatttgtaacaacctccctca

SEQ ID NO: 58895 - DNA, 218 bp, Homo sapiens
tgggtcaacaatgatatcaagagggaaatttaaaaattctttgaactgaacgataatagttacacaacctatcaaaaactctgggatacagcaaaagtggagctaagaagaaaattcatagcattaaatgcctatatcaaaaggtctgaaagagcacaattaaacattctaagggtcacacctcacagatttggagagactagaccagtccaattcca

SEQ ID NO: 58896 - DNA, 166 bp, Homo sapiens
gaggcagggaaaagccatctattcttctgcagcctaaggagcgagacttcaaggactcagtttggttccacccagttgaaagacacccagtgcacacccaaactcctggccttctgtggtttccctttgctccagaaacacagatgtgtctaaggagaaaaaaaaa

SEQ ID NO: 58897 - DNA, 136 bp, Homo sapiens
acaatgtttctaaaggcttatagttcaatacaawactctctctctgtttctaatagctatttgtgctggttatatctataggtaaacgagaacctaaatccttggcagttgaacaccctcttgaatctttcctgtt

SEQ ID NO: 58898 - DNA, 365 bp, Homo sapiens
atggccggggggtgagtcctatgtgatttttttcatgtttgttttatctgggggttgttcatgaaactgacagatgtttttctaaaaaggactattatcagtttccaaatacaatacttctctcttctggtttttcctgaatgagcctgattttgttgctggttttcatcatctatgagggtaaaacgagtacccttaaaatccctgtggccagtttgaacacccctgttgtattcttttctctgttcagtgtgtcagctattttgtgaagatgcttagatgtatagttttgataaccacagttttaaatcttttatctgtgcataataaaaagatatatatcagttattaaaaaaaaaaaaaaa

SEQ ID NO: 58899 - DNA, 260 bp, Homo sapiens
aagggtggggtagctgatgccctcctgtatagagccgacatgattcttacagttggtggaacagcatatgccatatatgagctggctgtggcttcatttcccaagaagcaggagtgacttcagtcatcccagcaatcgcttggttcagtttcattcagctctctatggaccagtaatctgataaataaccgagctcttctttggggatcaatatttattgacttgtagtaactgccaccaataaagcagtctttaccaca

SEQ ID NO: 58900 - DNA, 290 bp, Homo sapiens
aatagggaagcctgtgatgactacagactttgggaacgtacgccatggtttatggatacaatgctgcctataatcgctacttcaggaagcgccgaggggccaaatgagacttagggaagaaaaaaaatctctttttttctggaggctggcacctcattttgtatccccctgtagcagcattactgaaatacataggcttatatacaatgcttctttcctgtatattctcttgtctggcttgcacccctttttcccgcccccagattgataagtaatgaaagtgcactgca

SEQ ID NO: 58901 - DNA, 209 bp, Homo sapiens
tgtctcataaatggtttttgaaagttttgaagttataagagggatttgtcattatgtagagaatgaatactactaaccttccatctttttaaagaataaaacaaaaaaacaatgtgaccagatttaggaggtatttaaggaaaacctcagagtcacttcagagtgacagtcattgaaatgggatactaaaagaggtacagaaaggaaaa

SEQ ID NO: 58902 - DNA, 219 bp, Homo sapiens
atggccggggtatgtgaaaatgtctcataaatggtttttgaaagttttgaagttataagaggaattgtcattatgtagagaatgaatactactaaccttccatctttttaaagaataaaacaaaaaaacaatgtgaccagatttaggaggtatttaaggaaaacctcagagtcacttcagagtgacagtcattgaaatgggatactaaaagaggtacag

SEQ ID NO: 58903 - DNA, 218 bp, Homo sapiens
cacacttgttaaccagtcctgtttgctttcgtctttttttgtgcgtaataaagtcaactgaccaagtggaccatgaaaaggggctgtctgggggctcctgtttttttagctgctgttcttcagctccgaccatgttgctgtgtgattatctcaattgggtttaattgaggcaggaactgaagctctaccaatgaacttttttaggaacaaggcacact

SEQ ID NO: 58904 - DNA, 189 bp, Homo sapiens
aaatggaaaaaatagaaagagacaatcaaattcttgagcttaaaacaaagtatgtgcaacctaccatctcacttgaaatttaataaaataataagtaattatgtaaatataacatagagttatagatttatattttgttcataacacatagtgtaatataaggtgtatattttcaatgtttttggttta

SEQ ID NO: 58905 - DNA, 194 bp, Homo sapiens
tagtgatgaatagatattttcataagagtttaaaactgatatttggtggaagtagagagtaactcatattctatcaattcaagtattcttactatggttgctttccctatttgttcaatagacttataatactggaatttatagagggtttgagccattacaacttttgtgaggatgtgtttcgaacaattctg

SEQ ID NO: 58906 - DNA, 262 bp, Homo sapiens
ataggaaagcatattcagccaaccaagatgcaaatttttgaaatgatatgaccaaaattttaagtaggaaagtcacccaaacacttctgctttcacttaagtgtcttgcccccaatactgtaggaacaagcatgatcttgttactgtgatattttaaatatccacagtactcacttttttccaaatgatcctagtaattgcctagagaatatctttctcttacctgttatttatcaatttttcccagtattttttatacggg

SEQ ID NO: 58907 - DNA, 265 bp, Homo sapiens
tttaatttataaaacatatcacacatttaattttatacagtatttacatatagcggaacatagggataactcagttttatgtaaatttttgttaagtgttgtagcctgcccagagtgacttctattttttcttctttgtctccaggtggtgaagcagtattttccaatttgaagattcatttgaaggtggctcctgccacctgcctaatagcagttcaaactaaattttttgtatcaagtccctcaatggaagtatgacgttggg

SEQ ID NO: 58908 - DNA, 294 bp, Homo sapiens
ttttaaatgaagtgattctaagatttggtttgggatcaataggaaagcatattcagccaaccaagatgcaaatgttttgaaatgatatgaccaaaattttaagtaggaaagtcacccaaacacttctgctttcacttaagtgtcttgcccgcaatactttaggaacaagcatgatcttgttactgtgatattttaaatatccacagtactcactttttccaaatgatcctagtaattgcctagaaatatctttctcttacctgttatttatcaatttttcccagtatttttata

SEQ ID NO: 58909 - DNA, 291 bp, Homo sapiens
gaaagctaatgatgagagcaatgagcattccgatgagattgatagtcaggaactttccaaagtcagccgtgaattccacagccatgaatttcacagccatgaagatattctggttgtagaccccaaaagtaaggaagaagataaacacctaaaatttcgtatttctcatgaattagatagtgcatcttctgaggtcaattaaaaggagagaaaatacaatttctcactttgcatttagtcaaaaggaaaatgctttatagcaaaatgaaagagaacatgtagatgctgctg

SEQ ID NO: 58910 - DNA, 289 bp, Homo sapiens
aaaataagaaatttaatttaatgttagatgttaagaagttttaatgtgtaatgtttttgaagaattgaaaatagggaggagtatttatgtgttagttgaatttaataattttatttgaattaggtaatgtttggtttgaggagtagttgagatattttagtatatagtataatttaataaatgaaggatgtttaatatatttagtggggtattataaatagtgttgaagtgaaatagtgtatttatttaaagataatgtattattggaggggtgatatatgattataat

SEQ ID NO: 58911 - DNA, 610 bp, Homo sapiens
atggccgggagcttaaaacataaagaaaaccttgaatttctcaaatgtttgagatgttcaagacagtctcttaatccgttaatgcttttggaaacaattgacaaaatagggcaggcagctcatctcatgtcctgaagttggaatttaaataattcctatttgcaaattagaatgacagtgttggaatttggaggcagtagttgagcatattctctagtatatagctacacctttaataaaatgaaggaatgtcttcaatcatattttagtgggctatttataaatagtcttgaagtcaatttagtttatttatttaaaagataatgcattctgaaagggatcatttatgaataacaatctgaagtcttttcataaaaaaaattaataaactttagttgtacatttagccagtgttatttgaagtatgtaacttttaaaatattaagtgtcctgtatgattaagaatatgtgaatggagtaacttattttgtatcagggaatgttttgggaactgtggttttcactcaaaaccactggacttaacaagaatactgctgtggtataacaatgtacctaaatattacaggttattggtgcaataaacaagatt

SEQ ID NO: 58912 - DNA, 188 bp, Homo sapiens
agaaactattaaaggtattcagaaacgtgaaggccagccattgtttcgcaattcggcattttgaaaacaaatttgccgttgaaacttttatttgttcttgaacaagtcaaggaaaacaatatttagggaaacttatatcacaacatataccccacccctttacacatttgtgtcagatgtatatatat

SEQ ID NO: 58913 - DNA, 171 bp, Homo sapiens
cttataaaattacatattctgaaagaggattcccaaagatgggacttgttgaactcttacacatgatggaagtattaaggcttccagtataacttagaggaaggtctcttgcctctctgtacacagagagacagactatactctatattggaacactctccgcactctaga

SEQ ID NO: 58914 - DNA, 142 bp, Homo sapiens
gaactggaagaagaagtacggaagcgagaaagaatagagaagatagggaaattagaagataaaaacatacttttagaaggaaaaagataaatttaaaccctaaaagtaggaagcaggagaaaaaagacaagctagaggaaca

SEQ ID NO: 58915 - DNA, 244 bp, Homo sapiens
aagacagattgtgaattaaagagattaaaggatagaggattctgtttctttgttttgatttgcgcttttaggtattaaaataaggcccagatcacattaaaattagtaacagaaggagaacccttatagatttaaagtcaagtaattctctcttaaatttgatgtgtttctctctatataagagataactctataaatagggcacactcttccacgggctcttcacatctcagcgagaagagcc

SEQ ID NO: 58916 - DNA, 171 bp, Homo sapiens
acgtgatttaagatttggttggatcaataggaaagcatattcaggcaaccaagatgcaaatgttttgaaatgatatgaccaaattttaagtaggaaagttaaccaaacaattcttgtttcacttaagtgtcttggcccaatactttaggaacaagcattatcttgttactt

SEQ ID NO: 58917 - DNA, 209 bp, Homo sapiens
aaaagaagtctggaaacaagctggaaaaggtcttttttaataaaagatataatagtatggcaattatattgttccaaatgtcaaaatttgtgattttttagaagtacttgctatttatcttcttaaggcttcaatgatattcttgtgttaaataagcatgtcttgtacctgccttctgattcataaaatttatgaagagacctagagag

SEQ ID NO: 58918 - DNA, 248 bp, Homo sapiens
ggattacagcagcatctctatctggaaataccttgctttgtccaagtaaccttctcccacacagagtaccccaatcagctcagattttttttccttaatattggcaacacttaatgctacttctttgttcgtaacatttcatttaattatttaaaaatctgcaaatgttgtgtatattttaccgcaatttttaaacaaactccagtctagaccgtgctctagcatttctaaaaataaaagtaaatata

SEQ ID NO: 58919 - DNA, 270 bp, Homo sapiens
gaaaggtggggaaaagattgagaaatcggatggttgccgtgtctgtgtggaaagaagtagacatgggagacttttcattttgttctgtactaaggaaaattcttctgccttgggatcctgttgatctgtgaccttacccccaaacctgtgctctctgaaacatgttctgtgtccactcagggttaaattggattaagggcggtgcaagatgttcttttttaaacagatgctttaaggcagcattcttcttaagagtcatcaccacttcct

SEQ ID NO: 58920 - DNA, 230 bp, Homo sapiens
tcttgtcagctgtctttcagaagacctggtggggcaagtccgtgggcatcatgttgaccgagctgtgagaaagccttgaactctatcatcgacgtctaccacaagtactccctgataaagggggaatttccatgccgtctacaaggaatgacctgaagaaattgctagagaccgaagtgtcctaagtatatcaggaaaagggttgccagacgtctggttcaaagagttgg

SEQ ID NO: 58921 - DNA, 205 bp, Homo sapiens
tttcagttttatcagttcaagtacagcaaactctggataatatggttaattacttcctccatgattctttcgaccttcatatcaattttgctaaatatggaatgattgactagccagagcaatcaggaaagagaaagaattaaagggcatccaaattggaaaaggaggaagtcagattgtacctctttgcttgacaccatgattt

SEQ ID NO: 58922 - DNA, 243 bp, Homo sapiens
gacagagactgacatggaacaggggaagggcctggctgtcctcatcctggctatcattcttcttcaaggtactttggcccagtcaatcaaaggaaaccacttggttaaggtgtatgactatcaagaggatggttcggtacttctgacttgtgatgcagaagccaaaaatatacacatggtttaaaggtggaagagatgatcgctcttctcattcgagagataaaaaaaatgtgagatctctgg

SEQ ID NO: 58923 - DNA, 221 bp, Homo sapiens
tctcttgtcagctgtctttcagaagacctggtggggcaagtccgtgggcatcatgttgaccgagctggagaaagccttgaactctatcatcgacgtctaccacaagtactccctgataaaggggaatttccatgccgtctacagggttgacctgaggaaattgctagagaccgagtgtcctatgtatatcaggaaaaagggtgcagacgtctgtgttacaa

SEQ ID NO: 58924 - DNA, 209 bp, Homo sapiens
taatgaaaccttgggatgaatgaaggcccaatatgcttttcttgaaaaagtatgtacactagaaagaaaatgttactatatttgctatgtgatcagcttaatcatcaatatgtaatcaatatataatcattggagttaacaaatggaaacttctgattctttcttagaaatgctaaaaccactttacctaggtttttctcgatgttgcc

SEQ ID NO: 58925 - DNA, 384 bp, Homo sapiens
atggccggggtaacagaaagctctatgttttaattttttatatacaattaggataattagcattgtcagactataaacctttgctttttaaagtttatttttactatttctttatcactttattgtatcatcaccattggtttcataatgtaaatactatatgttgaacaaattaaatgtcaaaattttttattaccatagtccatgttaatagtggggctttcaggtgtttagagattttttttgttgttgttaacattcattgcaaaagtactagatggggtataactctagagttgaattttaagggattccctaatatgtatactatctttttatcctgaagtaataaataaacaatgaccttgaaagtgcctgaatcct

SEQ ID NO: 58926 - DNA, 210 bp, Homo sapiens
gagggtgctagaaaggacttataggaggatttgtgcccatgttcagtgatttcagtcagggtttagggaagccaggcttctctctggcttggatgctgtcagaggtgggggtatgtctatgacggcctatcttaatgagtcttgcccagagggagagaagattagttggaggctaatcctgtaattggtaaggaccaccagtcactctct

SEQ ID NO: 58927 - DNA, 240 bp, Homo sapiens
ctgaagctgacagcattcgggccgagatgtctcgctccgtggccttagctgtgctcgcgctactctctctttctggcctggaggctatccagcgtactccaaagattcaggtttactcacgtcatccagcagagattggaaagtcaaatttcctgaattgctatgtgtctgggtttaatccatccgcacattgaggttgactcactgagagattgagagagagaattgaaaagagtggag

SEQ ID NO: 58928 - DNA, 275 bp, Homo sapiens
cgatgtttcttttcccttaactttttattttaaaaacttgcaaacacagaaaagttgataaaatcatacagtggaacatctgtattctattcaactgggattcactagttcacattttgtcatatttgtgttctcttttccccatatggaggattgtatatttgccctttttccccctgaatcatttcagagtaagtgtgccagtatcatagcatttacactgttaagtcacttttgacagatatctcctaagagccaggatattctcctatata

SEQ ID NO: 58929 - DNA, 528 bp, Homo sapiens
atggccgggggattggatgaattccaaattctgcttgcttgctttttaatattgatatgcttatacacttacactttatgcacaaaatgtagggttataataatgttaacatggacatgatcttctttataattctactttgagtgctgtctccatgtttgatgtatctgagcaggttgctccacaggtagctctaggagggctggcaacttagaggtggggagcagagaattctcttatccaacatcaacatcttggtcagatttgaactcttcaatctcttgcactcaaagcttgttaagatagttaagcgtgcataagttaacttccaatttacatactctgcttagaatttgggggaaaatttagaaatataattgacaggattattggaaatttgttataatgaatgaaacattttgtcatataagattcatatttacttcttatacatttgataaagtaaggcatgggtgtgggtaatctgggttattttgttccacaagttaaataaatcataaaacttga

SEQ ID NO: 58930 - DNA, 224 bp, Homo sapiens
attcctgaagctgacagcattcgggccgagatgtctcgctccgtggccttagctgtgctcgcgctactctctctttctggcctgggaggctatccagcgtactccaaagattcaggtttactcacgtcatccagcagagattggaaagctcaaatttcctgaattgctatgtgtctgggtttcatccatccgcacattgaaggtgacttactgaaggatggagg

SEQ ID NO: 58931 - DNA, 300 bp, Homo sapiens
tttgtgtgtaaacggggatatcgtctttcatcacgttctcacacattgcgaacaacatgttgggatgggaaactggagtatccaacttgtgcaaaaagatagaatcaatcataaagtgcacacctttattcagaactttagtattaaatcagttctcaatttcatttttttatgtattgtttactccttttattcatacgtaaaatttgggttatttgtgaaaatgtaattataagctgagagcccgtggctctcttcttaaaaagcaccctatttaatcctcgagaaaaaaaaaaaaaa

SEQ ID NO: 58932 - DNA, 290 bp, Homo sapiens
aaaaaacaaaaaacaactgaccagttgttgataaccactaaggggtctctattaaaattactgatgcagaaagaccgtgtgtgaaattctctttcctgtagtcccattgatgtactttacctgaaacaacccaaagggtcccttttctttcttctgaggattgcagaggatatagttatcaatctctagttgtcactttcctcttccactttgataccattggggcattgaatataactctttccacataaaggtttatgagagatgccactgtgaaaaaaaaaaaaaaa

SEQ ID NO: 58933 - DNA, 210 bp, Homo sapiens
gactggttaatgatagcaatgcatcgtaaaaccttcagaaggaaaggagaattgttttgtggaccactttggttttcttttttgcgtgtggcagttttaagttattagtttttaaaatcagtactttttaatggaaacaacttgaccaaaaatttgttcacaggattttgagacccattaaaaaaggttaaacggaaaaaaaaaaaaaaa

SEQ ID NO: 58934 - DNA, 303 bp, Homo sapiens
gaaagaaataacatggaattctatttgaaggacaacagaacgttcctggaaaagcagctccagttggtttttcaactgtcaaacttgaatgtgtaagtccccacagagcatggacagtcggtgcagagttccaagggaacaattattgcctgatgaccacttccattttgtatacaactcttggtcggataaggccaatatccaaactgggcttttaggtaatagagaccgagtatataatgtatcaagatacaattagaggttctaacctagtgtgttaatatatctgaagttgggattttt

SEQ ID NO: 58935 - DNA, 301 bp, Homo sapiens
gaggtaagaacctaggaccaaagcacccaagattcagcgtcttgttactccacgtgtcctgcagcacaaacggcggcgtattgctctgaagaagcagcgtaccaaggaaaataaaggagaggctgcagaatatgctaaacttttggcccaagagaattaaggaggcttaaggaggagcgccaggaccaattgtccgaggagacgcagattttccttctctgccagcttctactctctaaggtctgaatccagcaagatataggatttttttgagtaacatatatataagatcagactctgg

SEQ ID NO: 58936 - DNA, 175 bp, Homo sapiens
aggtctttgtgggaagaaacagaaagaaatcacaaaagcaattaagagagctcaaataatggggtttatgccagttacatacaaggatcctgcatatctcaaggaccctaaagtttgtaacatcagatatcggggataaattctatcacggtaccaccaaaaaaaaaaaaaaaaa

SEQ ID NO: 58937 - DNA, 150 bp, Homo sapiens
agcatgatgaaactgtcataatggtgaatgttcaatctgtgtaagacaacaaactaaatgtagttgtcacactaaaatttcattggatattgatgaaatcattggcctggcaaaataaaacatgttgaattccccaaaaaaaaaaaaaaa

SEQ ID NO: 58938 - DNA, 303 bp, Homo sapiens
gggaggaaaagaccaaacttcaaggcctgcttttttcttaaagtactttaaaaaggaaatttgtttgtattttgatttacatttgatatttgcgctacatattttttagggttcagccatttttgatgatcttggatgaccacaccaggcctttggaggcgttctctgttctacttctgactttacttgtgtgtgtgaccatgtttcattataatctcagaggagagagagagcctctgtataaaacagcgaaagtgtcaacagagagacactcttttttcgagcgtctcagtactctgttgt

SEQ ID NO: 58939 - DNA, 322 bp, Homo sapiens
ttgcatggaaatcagccaagttttataatccttaaatcttaatgttcctcaagaggcttgggattagatacatatggatgtgactctcttgcaccagattatcttggatacaatcaggatttgtcctggtaaaaatagggtggtagtattgaggccaaggataattgccagatacattgagcttcatgcactctagaggagtgtatttgagagatatagagatttgtcacatatctacacccatgtgacactctctctagagatattttcacatctctgatcacatatatgtctctctgagaatatgcacatgatatgtata

SEQ ID NO: 58940 - DNA, 308 bp, Homo sapiens
gggatcatttctgggatgggaagggatgtgagatgatctgttactgcaacttcagcgaattgctctgctgcccaaaagacgtttctttggaccaaggatctctttcgtgattcctgccaacaatcaatgagaatcttcatgtattctggggaccaccattcctgttttcccaccaactgcattccatcagtttacctgcattctctggttctctattgagtgcatgagcgcatagtctctatatactctcactgtgtctgacacatgtatctctgtgtgacacgaggtgtgatgagaggtgatactac

SEQ ID NO: 58941 - DNA, 315 bp, Homo sapiens
tataaagacagtataaatatttgatatctgtgactctttttctctccatcgatttaaaagacaactgcataaggtaataattgtagaactgttattggaccatgggttatgaatgtatagggtgtaattgatgttaccattaaaaggtaaaaagggaagggaaaaaggggaccagacctattattggagtgaagtatttggatatacatatgtgggagataattgtgatatactatgtgggagttgtattgtgtatttgagagtgcgagtagatttgagtcacactcgagagtgttttaggatgagatgacacat

SEQ ID NO: 58942 - DNA, 397 bp, Homo sapiens
atggccggggaatataaaagacagtataaatattttatatctgtaactctttttctctccatcgatttaaaagacaactgcataaggtaataattgtagaactgtattgacatggttataatgtataaaaatgtaatttatgttacaataaaagtaaaagggagggaaaagggaacagaactatattggagtaaagattttgtatactattttgaaattatttgtatactattttgaaattatttgtattttgaaattaagttgattttaattcaaactagattgttttaagttaagttgtacattttaatccccaaggcaatcactaaaaaaataactcaaaaaataatgttaaagaaacaaagggattaaatgggataccaaaaaatatcctatt

SEQ ID NO: 58943 - DNA, 292 bp, Homo sapiens
ttgctaaaaaataaataaaagctagatactggaacctaactgcaatgtggatgttttacccacatgacttattatgcataagccagatttccagtttgagggatttgcctacaataaaaggagattttgccttcccaatttccaggatcaatcttttgaagcctttcctgttgatgtgacctgagcctactggggtgtatctctaatgcgcatgatatgtgaaatattggagagtgaatgagagtgcgctatattggagtaagccttctcttttggggatatccgggagagc

SEQ ID NO: 58944 - DNA, 319 bp, Homo sapiens
cagaagaagactcagcaaaataggttgatagagattaaacattctaaagaacagagggaagagagaataaagagaacagggccttaaataatgttggggcactattaaggcacaccaggatatgcatattgggagtaccagagggaggttaaggtaccagagaattattcaaggagttattgtctgagaatctcccaatatgtaattgtaaacgcattaagtgacacacatctcgagagggccccagagtgtccgtgtggggtatactgcagatacacatagcagacacatggttataaacgccgctgagctcctcgtc

SEQ ID NO: 58945 - DNA, 277 bp, Homo sapiens
atggccgggggcagaagaaagactcagcaaaataggttgatagagattaaacattctaaagaacagagggaagaaagaataaagaaaacagggccttaaaataatgtggggcactattaagcacaccaagatatgcataatgggagtaccaaaaggagattaagttacaggaaaattttccaaggaattatggctggaaatctccccaatggtatggtaatccattatggccaccttccaggagccccaaggatcccagttcgggataatccagttc

SEQ ID NO: 58946 - DNA, 315 bp, Homo sapiens
yagtaggagcaagaaaagctgtaagaatgaagcaatgaatcaagacttctacccaagcaacattttttgaactatattattcctttcttaagggatcctggaggaggttgaggtttttgaggttagggattccaattttccggttaacctccaaaccctaatttgatctgtgagaaaaaaaaaatttgtatttggggaaaaccccagatgtgagggggaaccccttttttcccctgggtcctctacacatttttgtgtgaccccatttttcctctgacatctgacagggcacacagtagtatctcttacactggt

SEQ ID NO: 58947 - DNA, 501 bp, Homo sapiens
atggccgggatagtaaggaagcaaagaaaaagctgtaagaatgaagcaatgaatcaagacttctacccaaagcaacatttttttaaactatatttattccttttctaaaggaatctagagaagttgaagtttttaagttaggaatgcaattttctgttaactccaaacctgattttaatctgaaaaaaaaaaaatttaatttgggaaacccagaatgaaaggaaacccattatggccttggttgcttaacattatttgtaaccaataatttccggcacctggcaggggcacaataagaatacctttactggatcccttaacaataagccttaatagccaatttccatggtatatgccaaagtggattagcacaatggccaattttcctttggttaaaatccaattcaaagattaattcttggcaaggaattccaaaggtcgggaaaccaattcatccaaaaatcccaaataaaccctgggaccctatttatccaggggggt

SEQ ID NO: 58948 - DNA, 299 bp, Homo sapiens
aatcattatcagacgtctaaacacctatggctttgactttgttattgatccagattattttccttgcatttgggagaatatcttcatatttgtttgctgtagaggtgggtttgcaaggattagtcaatgcccaggcaaacttccaattcaagaggccccttgttcttattatatatatgaggaagagggtgtatatccactcggggcacatatatctttgtgagtatatgtgctctgagagctagagagctctgagaaatctctattgtgagatcgagacagacacatatctcagagta

SEQ ID NO: 58949 - DNA, 250 bp, Homo sapiens
aacaagataaaacactgctaagtctaaatctaaaacagaccaagagtaccttcatttaaatttagcttgcacagagcttgatgcctatccttcattcttttcaggaggaaaggataattattggcacttatggccaaagttcaatatttgattaaggtttacctgaaggtacacatacttgatttgtgtgaggcttgaatacacaagggatataaaaactctcacacatttcccaccgcgacaaaagaag

SEQ ID NO: 58950 - DNA, 144 bp, Homo sapiens
ggagagagattgcatctaaagcggtaaaacctggtaggggtgtgtcacttcaaatgtctattacactgggtcatgtgcatctggtgtaggagtttttctaccataagtgacaaccataaatgtttgttatttaaaaaaaaaaaa

SEQ ID NO: 58951 - DNA, 82 bp, Homo sapiens
gtagagaagtatccaattatgtgacaacctttgtgtaataaaaatttgtttaaagttaaaaaaagaaaaaaaaaaaaaaaaa

SEQ ID NO: 58952 - DNA, 320 bp, Homo sapiens
aggctagtcctataaaagtaatgacttcatagaaatggcattataattattaagttgatactctacaggtagctattgatataattagttttaataaaacatgctgcaaccatggtatacaacaaaaatacatttctttggtgattgaaattaaggccgtatttacaatgacttaatataagactgacttttatcctgcttcataacttgtatggagaactcaccaagacagaattcaatactgtgaaatatgcagcaagaagattggtctttacctaggctgtgtttcctaagctctgagttttcagcaccagtagatt

SEQ ID NO: 58953 - DNA, 229 bp, Homo sapiens
tactggtaaattatgttatttttcacaactaattttgtactctcagaatgtttgtcatatgcttcttgcaatgcatatttctcaatctcaaacgtttcaataaaaccatttttcagatataaagagaattacttcaaattgagtaattcagaaaaactcaagatttaagttaaaaagtggtttggacttgggaacaggactttatacctcttttactgtaacagtacta

SEQ ID NO: 58954 - DNA, 222 bp, Homo sapiens
ataaaagtaaaacactgttaaagtgctgttttatgtgaaataacttgaatgttgttcctataaaacgtaggtcataactcatgatatgtttgtaatcatggtaatttagattttcagtgaggactgagtatctgcaaatattgtagcaatacttggtttaagattttggacctcagacactgtggctgtctaatgtaatcctttaaaaatctctgcattgtc

SEQ ID NO: 58955 - DNA, 224 bp, Homo sapiens
gaaggagaaaattctgaatttctagggtccaaaagttgacaaaaccattagtaggaggggtgggccatgttcattaagccatagtggtccctagttcattgttgagcaagttttagccctgcagttttcaccaccagcacctacccagcattctggtttttatgttttttatgtatctatgcagacaactgtgtattctgttttataacacgttgtttgaattt

SEQ ID NO: 58956 - DNA, 282 bp, Homo sapiens
aagaagaaatccgtgaggcattccgagtctttgacaaggatggcaatggttatatcagtgcagcagaactacgtcacgtcatgacaaacttaggagaaaaactaacagatgaagaagtagatgaaatgatcagagaagcagatattgatggagacggacaagtcaactatgaagaattcgtacagatgatgactgcaaaatgaagacctactttcaactcctttttcccccttctagaagaatcaaattgaatcttttacttacctcttgcaaaaaaaaaaa

SEQ ID NO: 58957 - DNA, 314 bp, Homo sapiens
aaagtcacccaaacacttctgctttcacttaagtgtctggcccgcaatactgtagggacaagcatgatcttgttactgtgatattttaaatatccacagtactcactttttccaaatgatcctagtaattgcctagaaatatctttctcttacctgttatttatcaatttttcccagtatttttatacggagaaaattgtattgaaaacacttagtatgcagttgataagaggagtttggtataattatggtgggtgattatttttgatactgtatgtgccaaagctttactactgtagagagacaactgtttt

SEQ ID NO: 58958 - DNA, 325 bp, Homo sapiens
gaaagggtttttcctgccacaggatataactttttttatataacaagcataacacaccactgcctttggtggaaaagtgcagaatagtatgtaccttttatgaagaaaaatgtaatttacaatattcagtgagaatgttactgctgattttcttttccaaggtgtagaatattctttgatttatagaattcatttttgacccagatgatggttcctttacagaacaataaaatggctgaacattttcacaaatagagtgtaacgcagtctggatttctgatacctgtcatttgggggattttattttactctgttgctttaaaat

SEQ ID NO: 58959 - DNA, 191 bp, Homo sapiens
aaaaggacaaaaaaatgtaaaagacttgaagtgagcttgtattataacattgatatagtggagagtatctgctttccaggctgaagtgattcattcattattctagtcctgctttagtcctttgtaatttgtggtaattatgcttttctttttaatacaaaaaaatgtataacagtaaacacttgaaaagg

SEQ ID NO: 58960 - DNA, 347 bp, Homo sapiens
aaggcagcctattcatcacaagacacacacatatacacggattggcatcaaactcaatgctttatttgtaaatttaagtgttttttaattctacctgtcaaaataatgtcaaaaccttttcctggttgcatggaaataagccaagttttttaatccttaaaatcttaattttcccaaaagcttgggttaaaatccaaattgggttttcctctctcgccccaaattatcttgaaaaataacaaatttgtctggtaaaaaaagggggtggatatggggccaagaatttgcaaaaccttgcgctcctgccctcgagggttttttggaaagagttgcctcctccctgtgca

SEQ ID NO: 58961 - DNA, 359 bp, Homo sapiens
catgtaattgtttctctggcaaatttgtatcagtaatttgaaaatgagatattagggaaaaccaattcttcttaaatttagttcatctttctttaaaagaacattaaatgtaaccattttgtcagatccatgtattttggagcataaaatgtatgctgttgtgaccaataaatataaaatatggtaattgggagtaactccacaccatagtatgcatggttatacatactgtgtacctaattatgtatagcagtgtagtctcacttatatctgacagtaattgtgcctaacaggtatgctttgcctaatctccacatatagctacctgtgatatagggatttgtgtatcagctcgttga

SEQ ID NO: 58962 - DNA, 296 bp, Homo sapiens
aagccttgtaaatgcctatattgtgggcttttaacgtatttaagggaccacttaagacgagattagatgggctcttctggatttgttcctcatttgtcacaggtgtcttgtgattgaaaatcatgagcgaagtgaaattgcattgaatttcaagggaatttagtatgtaaatcgtgcctcagaaacacatctgttgtctcttctgtgtttggtcgatattaataatggcaaaatatttgcctatctagtatctcaaatagtagtctgtgtacaccacaacagatgcggggtgtgtg

SEQ ID NO: 58963 - DNA, 353 bp, Homo sapiens
taatgagtgattctaagatttggtttgggatcaataggaaagcatattcagccaaccaagatgcaaatgttttgaaatgatatgaccaaaattttaagtagggaaggtcacccaaacacttctgctttcacttaagtgtctggcccccaatactgtaggaacaagcatgatcttgttactgtgatattttaaatatccacagtactcactttttccaaatattcctggtaatttgcctagaaatatctttctctaacctcttatatatcactttttccagtatttttatacggagaagattgtatgaaacactcgtatgcagttgatagaggatttggtatattatggtgggt

SEQ ID NO: 58964 - DNA, 235 bp, Homo sapiens
ccaattaagaaagcgttcaagctcaacacccactacctaaaaaatcccaaacatataactgaactcctcacacccaattggaccaatctatcaccctatagaagggactaatgttagtataagtaacatgaaaacattctctccgcataaggcctgcgtcaagattaaaacaattgaacttgacaattaaccagcccattttctccattcacccaccaggtccatttttcacaaa

SEQ ID NO: 58965 - DNA, 355 bp, Homo sapiens
ggaaaattaatatcacagcataaccccaccctttacatattgtgcagtgattattttttaaagtcttctttcatgtaagtagcaaacagggctttactatctttcatctcattaattcaattaaaacccattaccttaaaaattttttctttccgagggtgggtctttatattggaataagtacctgtataaggccatagatattagaacatgtcacctcaggtggaggggggagttcacamtyycttataacwcatwtmtckggatttatatgttttatgmgcaywcacargaggcggattatckagagagtactcatatataygcacacgaaaaaaagggccacagtcactta

SEQ ID NO: 58966 - DNA, 240 bp, Homo sapiens
tttcctttcttagctgatgtctttggccagaacaccgtgggctgttacttgctttgagttggaagcggtttgcatttacgcctgtaaatgtattcattcttaatttatgtaaggggtttttttgtacgcaattctcgattctttgaagagatgacaacaaaatttttggtttctactgttatgtgagaacattaggccccagcaacacgtcattgtgtaaggagaaataaaagtgctgtc

SEQ ID NO: 58967 - DNA, 215 bp, Homo sapiens
atttggatgattgctataagggttttaggatgttcctcccttttcttccaccctccccttttttttctattaataaagagaacttcaaaaggtaattggattgtcggtctctacaggctgagaactctgttcacctcccaagcattttaatagaaaaagctccctctctatttaatcaaacacactctcaccctgatgtgtagagtgtcacacat

SEQ ID NO: 58968 - DNA, 343 bp, Homo sapiens
taccgggaattcggccattatggccgggaagagtgagatgtagaaagttgtaaaatagaaaaagtggagttggtgaatcggttgttctttcctcacatttggatgattgtcataaggtttttagcatgttcctccttttcttcaccctccccttttttcttctattaatcaagagaaacttcaaagttaatgggatggtcggatctcacaggctgagaactcgttcacctccaagcatttcatgaaaaagctgcttcttattaatcatacaaactctcaccatgatgtgaagagtttcacaaatctttcaaaataaaaagtaatgacttagaaacggggaaaa

SEQ ID NO: 58969 - DNA, 235 bp, Homo sapiens
ttaaaaataaatcagaatttcaaatttaaaattgtccacacactagggaattaggacctgtgttaatatataaggcctttgggggttataaggattaagggcttttctttcaatttccatttatataattgcgcacccctgaaaaaatgggtttttcacacatatattgtgatattttctctgtgatatatgcagaaactcgcgtgacctgtgaaaatatagagggccccattga

SEQ ID NO: 58970 - DNA, 232 bp, Homo sapiens
  misc_feature 200: n = A,T,C or G
ttattggtctccagagtgcagctctgggagccttttgaaggattcagcactcattaagagttgagaggagagaaggccctaattggggtggttacccaccagcaacacaacctttcctccaaggttgttcctagaggcctcacacacagatattatattttggacatgttctctggccctctcttaaagaggccccaccnctaaatgggacattgtctctgtttccccactg

SEQ ID NO: 58971 - DNA, 350 bp, Homo sapiens
atggccgggatagacaactgggtaacttatatttctttgtaatcaagacttgagatatcgaagtcagttattggtctccagagtgcagctctgggagccttttgaagaatcagcactcattaagagctgagaagagagaagacctgattgggtggttgactagcagtcacagaacctgtcctcccaggctgttcctgaggcctgaccacagtatttattttggcatgtctctggccttctgcagaggcccaccctcatgggcattgtctctgtttcccagtgggggtggacagtatatcagatggtcagaacaaataaagtcagtgtcaaattaaaaaaaaaaaaaaaaa

SEQ ID NO: 58972 - DNA, 242 bp, Homo sapiens
taatttttatttgtgggatttttctataacaaaacaagtagctctaggaaaagagggttttatttttgtaaacgatcatttgtgacctcagacactctctggctaatattttaataaggtcacaacagataattcttgaggacaatggtgaagggttggcaatttgagagattaaaattggcataaggttcatacatttttgtctaggcgtgttgagattcacatttttaaatatagtgtcc

SEQ ID NO: 58973 - DNA, 202 bp, Homo sapiens
gggagaacactcaataaattatgttaactgtgcccccgagttaaaattttatggagtatatgtgaaacttgaacaacttaagacttttttaattgataaaaatgcttagtattgcccttttgggcttccagtaaattaaggagtttattgaggtacctacaacttaatattggtttgtggtgttcccgggctttatatcctt

SEQ ID NO: 58974 - DNA, 243 bp, Homo sapiens
ccaagttttataatccttaaatcttaatgttcctcaaagcttggattaaatacatatgggatgttactctcttgcaccaaattatccttggatacatcaaatttggtcttggtaaaaaatgggtggaggattttgaggcccaggatatttccaaatacacatgaggggtcaagcccactaaagggagggattttttggatttagagatgttgcactacactcccccagagtgaccctttctct

SEQ ID NO: 58975 - DNA, 244 bp, Homo sapiens
atgtttaaattataagtttttttgttttgtttttcagtaagtataaatgaaaatattcatatgtaaaatatgttttgcttaatgtggacaatttacacaaccaacacatactggtttccaaattatttctatattacacacaaggatggtatcccttaaaaaggggagggtctttatatatgtgttatataaccccggggaaagagcacatttggcgctcacatccccatggcgcttataaaac

SEQ ID NO: 58976 - DNA, 231 bp, Homo sapiens
gtatgaaagtctctttatgatgtttgtttttttgtcatttttgttctttacatcaaggaaattttatgtttaaatatgcggagaatgtatattgccccttcttccatcaaggttgctaaaccccctgaacatcgtatataaaatgtattaaaactctggggttggtaccccagtgctgtgactctgtatataggagttttatataatgtatgtgtttagagataaaatata

SEQ ID NO: 58977 - DNA, 239 bp, Homo sapiens
cactttggaatatttatgcttttctttgtgtggcatgactgacatacatactcaaatataggctgtctctagtaaatcttaaaatcttgaagctaaaattaattctttttattgaggtgtgagaagtcagtcactttgtgacggttctttctagcagtgttaatacatagcacagaagtgaagagcattttgtcgcttgaactcggcacatagcacataccacaaactccacagagaaa

SEQ ID NO: 58978 - DNA, 282 bp, Homo sapiens
ttacattcttgctcaattgaggcattattatgatgttcatactttccctcttgtttgaaagtttctaattattaaatggtgtcggaattgttgtattttccttaggaattcagttgaacttatcttcattaaatttagcttgtaccagggtgatatgacttgtcaatattatgtgtcaactttaaggcttaggtttcggttgtgcccttgattaataagtatatctctctatacaatatatatctgcttttctcgagaaaaaaaaaaaaaaaaaaaaaaaaa

SEQ ID NO: 58979 - DNA, 344 bp, Homo sapiens
ggtgtgtatattaatccaattatggacttaaaatattttaaaagtataaatacccttatttgctgcaaagaccagtgtgtaggcatttgctttttgagcaatatttttaaggtgcttccattttaatggccggggataaggctttttggaaccacaaaccttggcaaggataaggtattcaagtatttttcaaaggtaagaccacacatgtgtttgcacattttagcgcgtgcaattctgttaaacacatcaatgtgagtgaaacacatgtctcttagtctcttttatattacgacacacaccccgtgtataagtgtgtgtctctcgagagaaaaaaaaaaaaa

SEQ ID NO: 58980 - DNA, 211 bp, Homo sapiens
gactggttaatgataacaatgcatcgtaaaaccttcagaaggaaaggagaatgtttttgtggaccactttggttttcttttttgcgtgttggaagtttaaggttaataagttttaaaaataagacttttttcaatggaacaacccttgcaccaaaaattttttacacagaattttgaggacccaattaaaaaagagttaaaaaaaaaaaaa

SEQ ID NO: 58981 - DNA, 206 bp, Homo sapiens
catggtgaactgtgtctcaactaaaaatacaaaaattagccatgcatgatggcatacccctgtagtcccagctactcaggaggctgacacacgagaattgctttgaccccggaggcagaaggtaatacttgaggctaggacctgccggtgcaatccaggccttgggaacaaagaccaaggcccttgtctttaaaaaaaaaaaaaaa

SEQ ID NO: 58982 - DNA, 352 bp, Homo sapiens
gatttgttttaaactgtacagtgtcttttttttgtatagttaacacactaccgaatgtgtctttagatagccctgtcctgggtggtattttccaattagccactaacctttgcctggtacaagtaatgggggggtgttaaatttggattggaaattttaaaggaaggtctttttttgggtcacacagacacaaattagtgtatatatatgggggttgggtgagtttttcacatctcaaagtgtgctctcatgtgagagctatacacgaataataatttgtgtggctcttaacaactaatatcacctactctgattaattcgccaaaaaaaaaataaagagtgaaaaaaaaaa

SEQ ID NO: 58983 - DNA, 433 bp, Homo sapiens
acagcatatagaatatattatcagacaagatgaggaggtataaaagttactattgctcataatgacttacaggctaaattagtttaaaatactatattaaatgctgaatgcaatttttttttgttcccttgagaccaaaatttaaggttaactgtgcctggcgggttagggtttaaatgttaccaccgggggaggttaaagattttgcgcggctgtttcgcatagattccccaaatggaaacactcccctgggcgagagttgggaaaacccttattgacgcctgacccctcgtcgagaacacgacgacgtttttttttgtgtgtgtggtagtgttccagaggtttggtggccacagatctcccaccacagcagctttatcttctcgagagaggttctcccgccgcagattctccccccccccggaggactaat

SEQ ID NO: 58984 - DNA, 423 bp, Homo sapiens
tacttttttctattttgagttcactacttattgccttggctatgtctttcggtgcagcatgaaataactgaataattctttgttctttctgattttattagggaattactttccatgattataatttgaggaactgtgtggacatttggaaaggttttattccttttcctaggaggaaattatatatctctaaattactcatatattggggtcacagagggtcccgtctgagagtgctctatatctcacatttaatatatatctaagtgttaaaatctcttgtggaggaggatctctggggctctctctaggggcagcagcagattctcaaaatatgatgactactgtcatcagcagcggagctgtactccttattacaaaacaccagccgcaacacccccgtttttggtactactagaaaac

SEQ ID NO: 58985 - DNA, 484 bp, Homo sapiens
ttatggccggggcatcatacttttttctattttgagttcactacttattgccttggctatgtctttcggtgcaacatgaaataactgaataattctttgttctttctgattttattaggaattactttcatgattataatttgagtactgtgttgactatttgtataagttttattctttttcttaagaagtaattatattcttaattaactatatttgatgatcagaagttcctgttgatgttctataaatctcaattaaatataaattaatgttttaaaatctgttgagaagatgactggtctcctctctaggtcagcagatttgctaatatatgttactctgcatagctggagctactttattacatacctagctcaatccttttgttacttgagaatctaagatatccaagtagatgatatacactattttatgctgaatcatgtggacataagcgtatatcacatgactcacatattcg

SEQ ID NO: 58986 - DNA, 210 bp, Homo sapiens
ggtcgtgtttgtgcttttctccaagtcagcacccaaaggtcaatgcacagagaccccgggtgggtgagcgctggcttctcaaacggccgaagttgccttttttagggaatctcttttggaatttgggagcacgaatgacctctgaggtttgagcctatataaaaggaacttctttacaaaatggcaaaaaaaaaaaaaaaaaaaaaaaaa

SEQ ID NO: 58987 - DNA, 432 bp, Homo sapiens
cacttgagagtctgttcataaaattgtatttatcagtagaagggaaaattgccttatttgtgttttagggaaagatgctaccgtacctgttaaaaacaacagattctgttatattattctaataatttcacgcatacattaagcataggctgtttgttttaaatggctaaatatcatgaaagggtacttttacagctcaaaattaaggtctataggtttataacgcacacaaattggtgtagagacataaatacataatttggtgttatgcgtctatttaactcttaatcgcgagagagagagacaagagagagtcgctttgaaatatactgagtacccctatttgactcgctatagaaaaattggaaaattgataaatatataagggggaattcggcacccctatacccctcagaggtcacacatgtgaag

SEQ ID NO: 58988 - DNA, 211 bp, Homo sapiens
gcggggattgaaagttaagctattaaatatagggtgattatagtgtgtttaaaagccttgaaagaaaatatttggtattacacattacaccaggttgtacactgtatttgtaaacttcctcttgcatatggttttgcctttggtagccaaacagtgttgggggaggggcgatgtcaccacatggataatatgttatttgtggaaaaaaaaa

SEQ ID NO: 58989 - DNA, 211 bp, Homo sapiens
tgatgcgggtgaggaaattactgtcttgactgccatgtgttcatcatcttaaggattgtaagctgctatgtatggaattaaaccgtaatcatatctttttcctatctatcttaggcacttgtggagtaaaaaacacctatatattactctgttgcagatagagtttccgcatctttgcaaattcagagatggtggagcggcaaaaaaaaaa

SEQ ID NO: 58990 - DNA, 245 bp, Homo sapiens
tgaccaaattttaagtaggaagtcaccaaacacttcttctttcacttaagtgtcttgcccgcaatactgtaggagcacagcatgatctctgttactgtgtatatatttaaatatctacagtactcacctcctttcccatgatactcgtaattgcctcagaaatatctttctcttacctctgatttatcaatatttcccactattttttatacggggaaaatatgtgttttaaacaccaaggatgt

SEQ ID NO: 58991 - DNA, 231 bp, Homo sapiens
tgcgggactaaaatcagctgaataattcttaagtatacttcaagacaagtgtaaattgtttcaagctgttaaaggtaaacctaataaccattatcaaggcaactcctgggtaagtaacacttagaaccatcaagaggtggtttaaggggctggctataccccttcctctttagagcacaaagaaatcctatttaaaaaaaaatactacatggtctgtaaaaaaaaaaaaaa

SEQ ID NO: 58992 - DNA, 250 bp, Homo sapiens
tggtggcggggtgtgtaaactgatataacacatctcaggggagtatggaactatgtgtagctattaggggtttaatgctcacacagacatagtggatatgattttgggcctttaggaggcagctgaaaaagtgaggcgctttgcataaagttaagacctctgaatggctcccctatcttttaaaggaggaatacaaaaactacctaatagcctaggaacacgtaggaaatcataatataaaatgattaga

SEQ ID NO: 58993 - DNA, 31 bp, Artificial Sequence
  Modified T3 primer
gccaagctcgaaattaaccctcactaaaggg

SEQ ID NO: 58994 - DNA, 33 bp, Artificial Sequence
  modified T7 primer
ccagtgaattgtaatacgactcactatagggcg
